US008241878B2

(12) United States Patent
Anthony et al.

(10) Patent No.: US 8,241,878 B2
(45) Date of Patent: Aug. 14, 2012

(54) RECOMBINANT YEAST HOST CELL WITH FE-S CLUSTER PROTEINS AND METHODS OF USING THEREOF

(75) Inventors: Larry Cameron Anthony, Aston, PA (US); Dennis Flint, Newark, DE (US); Wonchul Suh, Hockessin, DE (US); Rick W. Ye, Hockessin, DE (US); Steven Cary Rothman, Wilmington, DE (US); Jean-Francois Tomb, Wilmington, DE (US)

(73) Assignee: Butamax(TM) Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 13/296,944

(22) Filed: Nov. 15, 2011

(65) Prior Publication Data

US 2012/0064585 A1 Mar. 15, 2012

Related U.S. Application Data

(62) Division of application No. 12/569,069, filed on Sep. 29, 2009.

(60) Provisional application No. 61/100,801, filed on Sep. 29, 2008, provisional application No. 61/100,806, filed on Sep. 29, 2008.

(51) Int. Cl.
*C12P 7/58* (2006.01)
(52) U.S. Cl. ...................... 435/137; 435/254.2; 435/160
(58) Field of Classification Search ........................ None
See application file for complete search history.

(56) References Cited

U.S. PATENT DOCUMENTS

| | | | |
|---|---|---|---|
| 4,683,202 | A | 7/1987 | Mullis |
| 6,177,264 | B1 | 1/2001 | Eggeling et al. |
| 6,699,703 | B1 | 3/2004 | Doucette-Stamm et al. |
| 7,851,188 | B2 | 12/2010 | Donaldson et al. |
| 7,993,889 | B1 | 8/2011 | Donaldson et al. |
| 8,017,376 | B2 | 9/2011 | Dundon et al. |
| 2007/0031918 | A1 | 2/2007 | Dunson, Jr. et al. |
| 2007/0092957 | A1 | 4/2007 | Donaldson et al. |
| 2008/0261230 | A1 | 10/2008 | Liao et al. |
| 2009/0155870 | A1 | 6/2009 | Donaldson et al. |
| 2010/0081154 | A1 | 4/2010 | Flint et al. |
| 2010/0081179 | A1 | 4/2010 | Anthony et al. |
| 2010/0081182 | A1 | 4/2010 | Paul et al. |
| 2010/0081183 | A1 | 4/2010 | Paul et al. |
| 2010/0112655 | A1 | 5/2010 | Paul |
| 2010/0129886 | A1 | 5/2010 | Anthony et al. |
| 2012/0064561 | A1 | 3/2012 | Flint et al. |

FOREIGN PATENT DOCUMENTS

| | | |
|---|---|---|
| CA | 2622026 | 5/2007 |
| EP | 1887081 | 2/2008 |
| WO | WO 2006/059111 | 6/2006 |
| WO | WO 2007/020992 | 2/2007 |
| WO | WO 2008/098227 | 8/2008 |
| WO | WO 2009/086423 | 7/2009 |
| WO | WO 2009/103533 | 8/2009 |

OTHER PUBLICATIONS

Garland et al., (JMB, vol. 294, pp. 897-907, 1999).*
Aden et al., Lignocellulose Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.
Altschul, S.F., et al., "Basic Local Alignment Search Tool," *J. Mol. Biol.* 215:403-410 (1990).
Ausubel, et al., Current Protocols in Molecular Biology, published by Green Publishing Assoc. and Wiley Interscience (1987).
Bellion, et al., Microb. Growth C1 Compd. [Int. Symp.], 7th (1993), 415-432. Editors: Murrell, J. Collin; Kelly, Don P.; Publisher: Intercept; Andover, UK.
Casey, "Cloning and analysis of two alleles of the ILV3 gene from *Saccharomyces carlsbergenesis*," *Carlsberg Research Communications*, 51:327-342 (1986).
Chen, et al., "Inhibition of Fe-S cluster biosynthesis decreases mitochondrial iron export: evidence that Yfh1p affects Fe-S cluster synthesis," *PNAS USA* 99:12321-12326 (2002).
Deshpande, M., "Ethanol production from cellulose by coupled saccharification/fermentation using *Saccharomyces cerevisiae* and cellulose complex from *Sclerotium rolfsii* UV-8 mutant," *Appl. Biochem. Biotechnol.* 36:227 (1992).
Durbin, et al., Biological Sequence analysis: probabilistic models of proteins and nucleic acids, Cambridge University Press, 1998.
Flint, D.H. et al., "The role and properties of the iron-sulfur cluster in *Escherichia coli* dihydroxy-acid dehydratase," *J. Biol. Chem.* 268:14732-14742 (1993).
Frohman, M.A., et al., "Rapid production of full-length cDNAs from rare transcripts: amplification using a single gene-specific oligonucleotide primer," *PNAS USA* 85:8998 (1988).
Garland, et al., "*Saccharomyces cerevisiae* ISU1 and ISU2: members of a well-conserved gene family for iron-sulfur cluster assembly," *J Mol Biol* 294:897-907 (1999).
Guo, W.F., et al., "Pervaporation study on the dehydration of aqueous butanol solutions: a comparison of flux vs. permeance, separation factor vs. selectivity," *J. Membr. Sci.* 245:199-210 (2004).
Hartmanis, et al., *Arch. Biochem. Biophys.* 245:144-152 (1986).
Higgins, and Sharp, "Fast and sensitive multiple sequence alignments on a microcomputer," *CABIOS* 5:151-153 (1989).
Higgins, D.G., et al., "CLUSTAL V: improved software for multiple sequence alignment," *CABIOS* 8:189-191 (1992).
International Search Report of corresponding International Application No. PCT/US2009/058826 mailed Nov. 26, 2009.

(Continued)

*Primary Examiner* — Hope Robinson
(74) *Attorney, Agent, or Firm* — Christine M. Lhulier

(57) ABSTRACT

Yeast strains were engineered that have increased activity of heterologous proteins that require binding of an Fe—S cluster for their activity. The yeast strains have reduced activity of an endogenous Fe—S protein. Activities of heterologous fungal or plant 2Fe-2S dihydroxy-acid dehydratases and Fe—S propanediol dehydratase reactivase were increased for increased production of products made using biosynthetic pathways including these enzymes, such as valine, isoleucine, leucine, pantothenic acid (vitamin B5), isobutanol, 2-butanone and 2-butanol.

15 Claims, 2 Drawing Sheets

OTHER PUBLICATIONS

Jensen, et al., "Role of *Saccharomyces cerevisiae ISA1* and *ISA2* in iron homeostasis," *Mol. Cell. Biol.* 20:3918-3927 (2000).

Krogh, A., et al., "Hidden Markov models in computational biology," *J. Mol. Biol.* 235:1501-1531 (1994).

Loh, E.Y., et al., "Polymerase chain reaction with single-side specificity: analysis of T cell receptor δ chain," *Science*, 243:217 (1989).

Mnaimneh, et al., "Exploration of essential gene fucntions via titratable promoter alleles," *Cell* 118:31-44 (2004).

O'Brien, et al., "Insight into the mechanism of the B12-independent glycerol dehydratase from *Clostridum butyricium*: preliminary biochemical and structural characterization," *Biochemistry* 43:4635-4645 (2004).

Ohara, O., et al., "One-sided polymerase chain reaction: the amplification of cDNA," *PNAS USA* 86:5673 (1989).

Pearson, Comput. Methods Genome Res., [Proc. Int. Symp.] 111-20 (1994), Meeting Date 1992.

Rychlik, In Methods in Molecular Biology, White, B.A., Ed., vol. 15, pp. 31-39, PCR Protocols: Current Methods and Applications. Humania: Totowa, NJ (1993).

Scott, et al., Whole-genome transcription profiling reveals gene upregulated by growth of fucose in the human gut bacterium "*Roseburia inulinivorans*," *J. Bacteriol.* 188:4340-4349 (2006).

Sulter, G.J., et al., "Proliferation and metabolic significance of peroxisomes in *Candida boidinii* during growth on D-alanine or oleic acid as the sole carbon source," *Arch. Microbiol.* 153:485-489 (1990).

Tabor, S., et al., "A bacteriophage T7 RNA polymerase/promoter system for controlled exclusive expression of specific genes," *PNAS USA* 82:1074 (1985).

Thein and Wallace, "The use of oligonucleotides as specific hybridization probes in the diagnosis of genetic disorders," in Human Genetic Diseases: A Practical Approach, K.E. Davis, Ed., pp. 33-50, IRL: Herndon, VA (1986).

Van Ness, J. and Chen, L., "The use of oligonucleotide probes in chaotrope-based hybridization solutions," *Nucl. Acids Res.* 19:5143-5151 (1991).

Velasco, J. A., et al., "Cloning of the dihydroxyacid dehydratase-encoding gene (ILV3) from *Saccharomyces cerevisiae*," *Gene* 137:179-185 (1993).

Wach, et al., "New heterologous nodules for classical or PCR-based gene disruptions in *Saccharomyces cerevisiae*," *Yeast* 10:1793-1808 (1994).

Walker, G.T., et al., "Isothermal in vitro amplification of DNA by a restriction enzyme/DNA polmerase system," *PNAS USA* 89:392 (1992).

Wycoff, H.A., et al., "Characterization and sequence analysis of a stable cryptic plasmid from *Enterococcus faecium* 226 and development of a stable cloning vector," *Appl. Environ. Microbiol.* 62:1481-1486 (1996).

Arthur, M., et al., "Contribution of VanY D,D-Carboxypeptidase to Glycopeptide Resistance in *Enterococcus faecalis* by Hydrolysis of Peptidoglycan Precursors," *Antimicrob. Agents Chemother.* 38:1899-1903 (1994).

Zirkle, R., et al., "Analysis of a 108-kb region of the *Saccharopolyspora spinosa* genome covering the obscurin polyketide synthase locus," *DNA Sequence* 15:123-134 (2001).

Dickinson, J.R., et al., "An investigation of the metabolims of valine to isobutyl alcohol in *Saccharomyces cerevisiae*," *J. Biol. Chem.*, 273: 25751-25756 (1998).

Dürre, P., "New insights and novel developments in clostridal acetone/butanol/isopropanol fermentation," *Appl. Microbial. Biotechnol.* 49:639-648 (1998).

Eden, A., et al., "Involvement of branched-chain amino acid aminotransferases in the production of fusel alchols during fermentation in yeast," *Appl. Microbiol. Biotechnol.* 55:296-300 (2001).

Eichenbaum, Z., et al., "Use of the *Lactococcal nisA* Promoter to regulate gene expression in gram-positive bacteria: comparison of induction level and promoter strength," *Appl. Environ. Microbial.* 64(8):2763-2769 (1998).

Flint, D.H. et al., "Dihydroy acid dehydratase from spinach contains a [2Fe-2S] cluster," *J. Biol. Chem.* 263:3558-3564 (1988).

Flint, D.H., et al., "Studies on the active site of dihydroxy-acid dehydratase," *Bioorganic Chem.* 21:367-385 (1993).

Flint, D.H., et al., "The inactivation of Fe-S cluster containing hydro-lyases by superoxide," *J. Biol. Chem.*, 268:22369-22376 (1993).

Fujimoto, S., and Ike, Y., "pAM401-Based shuttle vectors that enable overexpression of promoterless genes and one-step purification of tah fusion proteins directly from *Enterococcus faecalis*," *Appl. Environ. Microbial.* 67:1262-1267 (2001).

GenBank No. AF508808, Jun. 24, 2002.

Godon, J.-J., et al., "Branched-chain amino acid biosynthesis genes in *Lactococcus lactis* subsp. *lactis*," *J Bacterial.* 174:6580-6589 (1992).

Goossens, et al., "Control of diacetyl formation by the intensification of the anabolic flux of acetohydroxyacid intermediates", European Brewery Convention: Proceedings of the 21 st Congress, Madrid, 1987, pp. 553-560.

Groot, W.J., et al., "Technologies for butanol recovery integrated with fermentations," *Process. Biochem.* 27:61-75 (1992).

Horton, R.M., et al., "Engineering hybrid genes without the use of restriction enzymes: gene splicing by overlap extension," *Gene* 77:61-68 (1989).

Imlay, J.A, "Iron-sulphur clusters and the problem with oxygen," *Mol. Microbiol.* 59:1073-1082 (2006).

International Search Report and Written Opinion of corresponding PCT/US2009/058827 mailed Jan. 4, 2010.

Kim, S. and Lee, S.B., "Catalytic promiscuity in dihydroxy-acid dehydratase from the thermoacidophilic archaean *Sulfolobus solfataricus*", *J. Biochem.*, 139: 591-96 (2006).

Kleerbezem, et al., "Controlled gene expression systems for lactic acid bacteria: transferable nisin-inducible expression cassettes for *Lactococcus, Leuconostoc* and *Lactobacillus* spp.," *Appl. Environ. Microbiol*. 63:4581-4584 (1997).

Maguin, E., et al., "New thermosensitive plasmid for gram-positive bacteria," *J. Bacteriol.* 174:5633-5638 (1992).

Methods in Yeast Genetics, 2005, Cold Spring Harbor Laboratory Press, Cold Spring Harbor, NY, pp. 201-202.

Nakamura, et al., "Hyperproduction of recombinant ferredoxins in *Escherichia coli* by coexpression of the ORF1=ORF2-iscS-iscU-iscA-hscB-hscA-fdx-ORF3 gene cluster," *J. Biochem.* 126:10-18 (1999).

O'Sullivan, D.J., et al., "High- and low-copy-number *Lactococcus* shuttle cloning vectors with features for clone screening," *Gene* 137:227-231 (1993).

Polaina, J., "Cloning of the ILV2, ILV3 and ILV5 Genes of *Saccharomyces cerevisiae*", *Carlsberg Res. Commun.*, 49:577-584 (1984).

Renault, P., et al., "Plasmid vectors for gram-positive bacteria switching from high to low copy number," *Gene* 183:175-182 (1996).

Rud, I., et al., "A synthetic promoted library for constitutive gene expression in *Lactobacillus plantarum*," *Microbiology* 152:1011-1019 (2006).

Rupp, H., et al., "Electron spin relaxation of iron-sulfur proteins studied by microwave power saturation," *Biochimica et Biophysica Acta*, 537:255-269 (1978).

Scott, H.N., et al., "Sequences of versatile broad-host-range vectors of the RK2 family," *Plasmid* 50:74-79 (2003).

Seffernick, et al., "Melamine deaminase and atrazine chlorohydrolase: 98 percetn identical but functionally different," *J. Bacteriol.* 183:2405-2410 (2001).

Sørvig, E., et al., "Plasmid p256 from *Lactobacillus plantarum* represents a new type of replicon in lactic acid bacteria, and contains a toxin-antitoxin-like plasmid maintenance system," *Microbiology* 151:421-431 (2005).

Tanimoto, K., et al., "Analysis of the conjugal transfer system of the pheromone-independent highly transferable Enterococcus plasmid pMG1: identification of a *tra* gene (*tra*A) up-regulated during conjugation," *J. Bacteriol.* 184:5800-5804 (2002).

Thompson, J.D., et al., "CLUSTAL W: improving the sensitivity multiple sequence alignment through sequence weighting, position-specific gap penalties and weight matrix choice," *Nucl. Acids Res.* 22:4673-4680 (1994).

Van Kranenburg, R., et al., "Functional analysis of three *Lactobacillus plantarum*," *Appl. Environ. Microbiol.* 71:1223-1230 (2005).

Villa, et al., "Control of Vicinal Diketone Production by Brewer's Yeast. I. Effects of ilv5 and ILV3 Gene Amplification on Vicinal Diketone Production and ILV Enzyme Activity", *Journal of the American Society of Brewing Chemists*, 53:49-53 (1995).

Watanabe, S., et al., "Identification and characterization of L-Arabonate dehydratase, L-2-keto-3-deoxyarabonate dehydratase, and L-Arabinolactonase involved in an alternative pathway of L-Arabinose metabolism," *J Biol. Chem.* 281:33521-33536 (2006)

Witkowski, et al., "Conversion of β-Ketoacyl synthase to a malonyl decarboxylase by replacement of the active site cysteine with glutamine," *Biochemistry* 38:11643-11650 (1999).

Ajdic, et al., GenBank accession No. ILVD_STRMU, Jun. 10, 2008.

Branden, et al., Introduction to Protein Structure, Garland Publishing Inc., New York p. 247, 1991.

Office Action mailed Dec. 30, 2011, in U.S. Appl. No. 12/569,636, Flint, filed Sep. 29, 2009.

Office Action mailed May 7, 2012, in U.S. Appl. No. 12/569,168, Paul, filed Sep. 29, 2009.

Office Action mailed Aug. 24, 2011, in U.S. Appl. No. 12/569,168, Paul, filed Sep. 29, 2009.

Office Action mailed Mar. 23, 2012, in U.S. Appl. No. 12/569,103, Paul, filed Sep. 29, 2009.

Notice of Allowance mailed Apr. 9, 2012, in U.S. Appl. No. 12/569,136, Paul, filed Sep. 29, 2009.

Office Action mailed Aug. 12, 2011, in U.S. Appl. No. 12/569,136, Paul, filed Sep. 29, 2009.

Co-pending U.S. Appl. No. 13/227,016, filed Sep. 7, 2011, first named inventor Larry Cameron Anthony, United States Patent and Trademark Office, Alexandria, VA, United States (Unpublished).

* cited by examiner

RECOMBINANT YEAST HOST CELL WITH FE-S CLUSTER PROTEINS AND METHODS OF USING THEREOF

CROSS REFERENCE TO RELATED APPLICATIONS

This application is a divisional of U.S. application Ser. No. 12/569,069, filed Sep. 29, 2009, which claims the benefit of priority to U.S. Provisional Application Nos. 61/100,801 filed Sep. 29, 2008 and 61/100,806 filed Sep. 29, 2008. The entirety of each is hereby incorporated by reference.

REFERENCE SEQUENCE LISTING SUBMITTED ELECTRONICALLY

The content of the electronically submitted sequence listing (Name: CL4213USCNT.txt; Size: 707,401 bytes; and Date of Creation: Sep. 27, 2011) is incorporated herein by reference in its entirety.

FIELD OF THE INVENTION

The invention relates to the field of industrial microbiology and the expression of proteins that require an iron-sulfur cluster for activity. More specifically, expression of heterologous Fe—S protein activity in yeast cells is improved through specific host gene inactivation.

BACKGROUND OF THE INVENTION

Engineering of yeast for fermentative production of commercial products is an active and growing field. Enzymatic pathways engineered for biosynthesis of some products include enzymes that require binding of an iron-sulfur (Fe—S) cluster for activity. Dihydroxy-acid dehydratase (DHAD) is one example. DHAD is part of naturally occurring biosynthetic pathways producing valine, isoleucine, leucine and pantothenic acid (vitamin B5). Increased expression of DHAD activity is desired for enhanced microbial production of branched chain amino acids or of pantothenic acid. In addition, DHAD catalyzed conversion of 2,3-dihydroxyisovalerate to α-ketoisovalerate is a common step in the multiple isobutanol biosynthetic pathways that are disclosed in co-pending US Patent Pub No. US 20070092957 A1. Disclosed therein is engineering of recombinant microorganisms for production of isobutanol, which is useful as a fuel additive and whose availability may reduce the demand for petrochemical fuels.

Diol dehydratase provides an enzyme activity in a biosynthetic pathway for production of 2-butanone and 2-butanol that is disclosed in co-pending US Patent Pub No. US 2007-0292927A1. Disclosed in US Patent Pub No. US20090155870 is a butanediol dehydratase that is useful for expression in this pathway due to its coenzyme B-12 independence. A diol dehydratase reactivase that is an Fe—S cluster protein required for activity of the B12-independent butanediol dehydratase, is also disclosed in US Patent Pub No. US20090155870. 2-Butanone, also referred to as methyl ethyl ketone (MEK), is a widely used solvent, extractant and activator of oxidative reactions, as well as a substrate for chemical synthesis of 2-butanol. 2-butanol is useful as a fuel additive, whose availability may reduce the demand for petrochemical fuels.

For improved production of compounds synthesized in pathways including an Fe—S cluster containing enzyme, it is desirable to provide a host cell capable of expressing high levels of this enzymatic activity in the production host of interest. Whereas a number of commercially relevant bacteria and yeast can express activity of Fe—S cluster containing proteins, this activity is at levels far below what is commercially useful for enhancing introduced biosynthetic pathways. Consequently a need exists for the discovery of host cells capable of expressing activity of Fe—S cluster containing proteins at levels high enough to enhance introduced pathways that have Fe—S requirements. Obtaining high functional expression of heterologous Fe—S cluster containing enzymes is problematic due to the Fe—S cluster requirement, which involves availability and proper loading of the cluster into the apo-protein.

SUMMARY OF THE INVENTION

Provided herein are recombinant yeast host cells comprising at least one heterologous Fe—S cluster protein wherein the yeast host has reduced expression of at least one endogenous Fe—S cluster protein.

The recombinant yeast cell may be grown under suitable conditions for the production of products including isobutanol, 2-butanol and 2-butanone.

In one aspect, the recombinant yeast cell comprises a disruption in the gene encoding the at least one endogenous Fe—S cluster protein.

In another aspect, the endogenous Fe—S cluster protein is selected from the group consisting of dihydroxy-acid dehydratase, isopropylmalate dehydratase, sulfite reductase, glutamate dehyddrogenase, biotin synthase, aconitase, homoaconitase, lipoate synthase, ferredoxin maturation, NADH ubiquinone oxidoreductase, succinate dehydrogenase, ubiquinol-cytochrome-c reductase, ABC protein Rli1 NTPase Nbp35, and hydrogenase-like protein.

In another aspect, the yeast is selected from the group consisting of *Saccharomyces, Schizosaccharomyces, Hansenula, Candida, Kluyveromyces, Yarrowia* and *Pichia*.

In another aspect, the endogenous Fe—S protein is expressed in the mitochondria, and in another embodiment, the endogenous Fe—S cluster protein has an activity selected from the group consisting of: dihydroxy-acid dehydratase and isopropylmalate dehydratase activity.

In another aspect, the host cell is *Saccharomyces* expressing a gene encoding a polypeptide having the amino acid sequence as set forth in SEQ ID NO:114.

In some embodiments, the at least one heterologous Fe—S cluster protein is selected from the group consisting of fungal 2Fe-2S dihydroxy-acid dehydratases and plant 2Fe-2S dihydroxy-acid dehydratases. In one embodiment, the heterologous fungal or plant 2Fe-2S cluster dihydroxy-acid dehydratase is expressed in the cytosol. In one embodiment, the heterologous fungal or plant 2Fe-2S cluster dihydroxy-acid dehydratase is a polypeptide having an amino acid sequence that matches the Profile HMM of table 9 with an E value of $<10^{-5}$ wherein the polypeptide additionally comprises all three conserved cysteines, corresponding to positions 56, 129, and 201 in the amino acids sequences of the *Streptococcus mutans* DHAD enzyme corresponding to SEQ ID NO:179. In one embodiment, the heterologous fungal or plant 2Fe-2S cluster dihydroxy-acid dehydratase is a polypeptide having an amino acid sequence that has at least about 95% sequence identity to an amino acid sequence selected from the group consisting of SEQ ID NOs:46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150 and 152. In one embodiment, the heterologous fungal or plant 2Fe-2S cluster dihydroxy-acid dehydratase is a polypeptide having an amino acid sequence that is at least about 90% identical to SEQ ID NO:114 using the Clustal W method of alignment using the default parameters of GAP PENALTY=10, GAP LENGTH PENALTY=0.1, and Gonnet 250 series of protein weight matrix over the full length of the protein sequence.

In another aspect, a method for the conversion of 2,3-dihydroxyisovalerate to α-ketoisovalerate is provided, said method comprising:

a) providing (1) a recombinant yeast host cell comprising at least one heterologous gene encoding a 2Fe-2S dihydroxy-acid dehydratase wherein the recombinant yeast host cell has reduced activity of at least one endogenous Fe—S cluster protein; and (2) a source of 2,3-dihydroxyisovalerate; and b) growing the recombinant host cell of (a) with said source of 2,3-dihydroxyisovalerate under conditions where the 2,3-dihydroxyisovalerate is converted by the host cell to α-ketoisovalerate.

In another aspect, a method for the conversion of 2,3-butanediol to 2-butanone is provided, said method comprising:

a) providing (1) a recombinant yeast host cell comprising at least one heterologus gene encoding a Fe—S propanediol dehydratase reactivase wherein the recombinant yeast host cell has reduced activity of at least one endogenous Fe—S cluster protein; and (2) a source of 2,3-butanediol; and b) growing the recombinant host cell of (a) with said source of 2,3-butanediol under conditions where 2,3-butanediol is converted by the hots cell to 2-butanone.

Also provided is a method for the production of isobutanol comprising growing a recombinant yeast host cell disclosed herein under conditions wherein isobutanol is produced.

In other embodiments, the at least one heterologous Fe—S cluster protein has Fe—S propanediol dehydratase reactivase activity. In some embodiments, the at least one heterologous Fe—S cluster protein having Fe—S propanediol dehydratase reactivase activity is a propanediol deydratase reactivase having an amino acid sequence that is at least about 90% identical to the amino acid sequence as set forth in SEQ ID NO:44 using the Clustal W method of alignment using the default parameters of GAP PENALTY=10, GAP LENGTH PENALTY=0.1, and Gonnet 250 series of protein weight matrix over the full length of the protein sequence.

In some embodiments, the cell produces 2-butanol, and in some embodiments the cell produces 2-butanone. In some embodiments, the cell comprises a 2-butanol biosynthetic pathway, and in some embodiments, the cell comprises a 2-butanone biosynthetic pathway.

BRIEF DESCRIPTION OF THE FIGURES AND SEQUENCE DESCRIPTIONS

The invention can be more fully understood from the following detailed description, figures, and the accompanying sequence descriptions, which form a part of this application.

Figure 1:
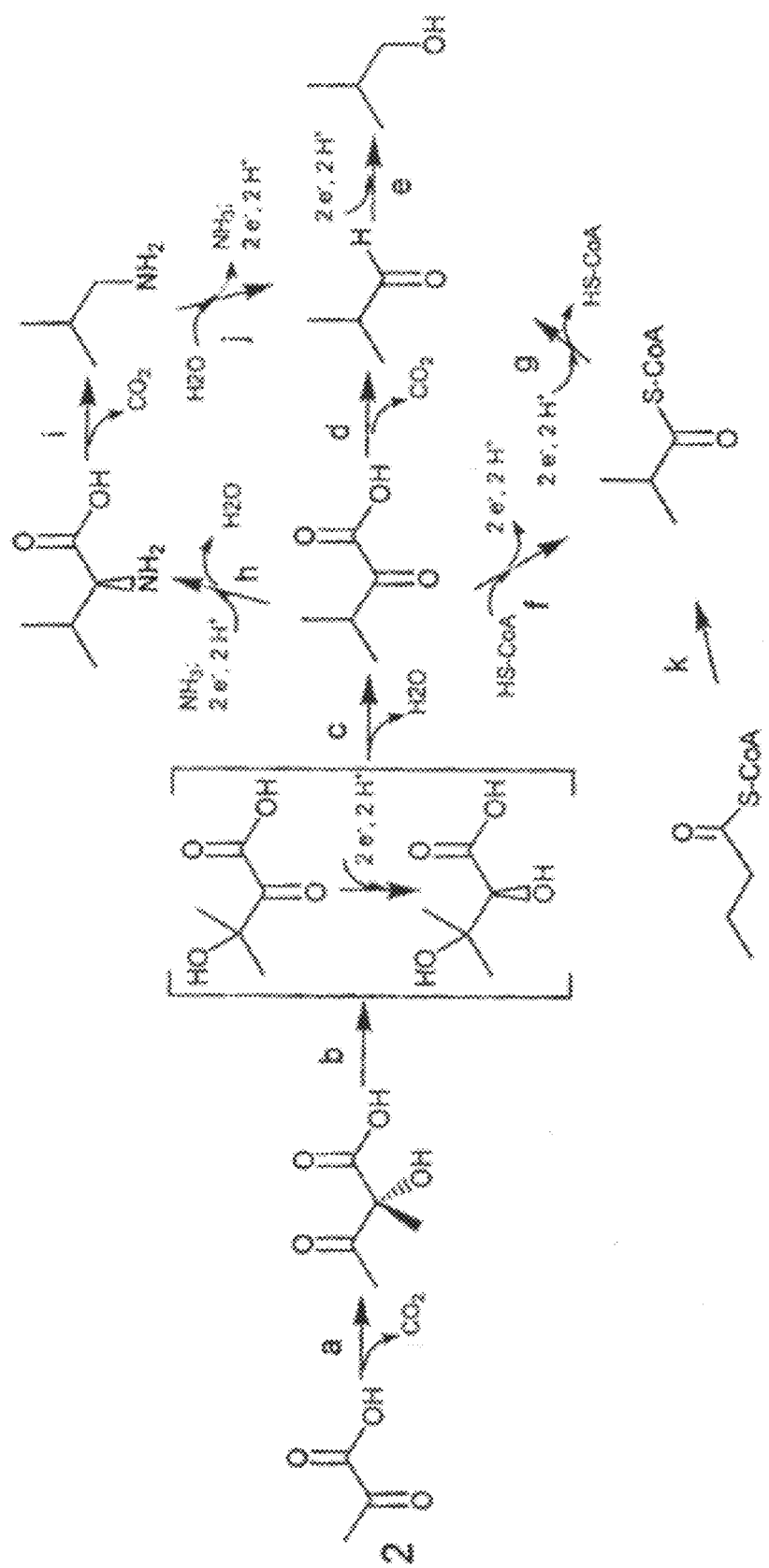
FIG. 1 shows biosynthetic pathways for isobutanol production.

Table 9 is a table of the Profile HMM for dihydroxy-acid dehydratases based on enzymes with assayed function prepared as described in Example 1. Table 9 is submitted herewith electronically and is incorporated herein by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

TABLE 1

Inactivation target Fe—S protein encoding genes

| Organism and gene | SEQ ID NO: Nucleic Acid | SEQ ID NO: Peptide |
|---|---|---|
| Saccharomyces cerevisiae LEU1 | 1 | 2 |
| Schizosaccharomyces pombe LEU1 | 3 | 4 |
| Candida galbrata CBS 138 LEU1 | 5 | 6 |
| Candida albicans SC 5314 LEU1 | 7 | 8 |
| Kluyveromyces lactis LEU1 | 9 | 10 |
| Yarrowia lipolytica LEU1 | 11 | 12 |
| Pichia stipitis LEU1 | 13 | 14 |
| Saccharomyces cerevisiae YJM789 ILV3 | 111 | 112 |
| Schizosaccharomyces pombe ILV3 | 93 | 94 |
| Candida galbrata CBS 138 ILV3 | 107 | 108 |
| Candida albicans SC5314 ILV3 | 101 | 102 |
| Kluyveromyces lactis ILV3 | 113 | 114 |
| Yarrowia lipolytica ILV3 | 105 | 106 |
| Pichia stipitis CBS 6054 ILV3 | 103 | 104 |
| Saccharomyces cerevisiae ACO1 | 153 | 154 |
| Schizosaccharomyces pombe (chromosome II) ACO1 | 155 | 156 |
| Schizosaccharomyces pombe (chromosome I) ACO1 | 157 | 158 |
| Kluyveromyces lactis NRRL Y-1140 ACO1 | 159 | 160 |
| Candida albicans SC5314 ACO1 | 161 | 162 |
| Yarrowia lipolytica CLIB122 ACO1 | 163 | 164 |
| Pichia stipitis CBS 6054 ACO1 | 165 | 166 |
| Candida glabrata CBS138 (chromosome F) ACO1 | 167 | 168 |
| Candida glabrata CBS138 (chromosome D) ACO1 | 169 | 170 |
| Candida glabrata CBS138 (chromosome K) ACO1 | 171 | 172 |

TABLE 2

Fungal and plant 2Fe—2S DHADs in addition to those in Table 1

| Description | SEQ ID NO: Nucleic acid | SEQ ID NO: Peptide |
|---|---|---|
| Chlamydomonas reinhardtii | 45 | 46 |
| Ostreococcus lucimarinus CCE9901 | 47 | 48 |
| Vitis vinifera (Unnamed protein product: CAO71581.1) | 49 | 50 |
| Vitis vinifera (CAN67446.1) | 51 | 52 |
| Arabidopsis thaliana | 53 | 54 |
| Oryza sativa (indica cultivar-group) | 55 | 56 |
| Physcomitrella patens subsp. patens | 57 | 58 |
| Chaetomium globosum CBS 148.51 | 59 | 60 |
| Neurospora crassa OR74A | 61 | 62 |
| Magnaporthe grisea 70-15 | 63 | 64 |
| Gibberella zeae PH-1 | 65 | 66 |
| Aspergillus niger | 67 | 68 |
| Neosartorya fischeri NRRL 181 (XP_001266525.1) | 69 | 70 |
| Neosartorya fischeri NRRL 181 (XP_001262996.1) | 71 | 72 |
| Aspergillus niger (An03g04520) | 73 | 74 |
| Aspergillus niger (An14g03280) | 75 | 76 |
| Aspergillus terreus NIH2624 | 77 | 78 |
| Aspergillus clavatus NRRL 1 | 79 | 80 |
| Aspergillus nidulans FGSC A4 | 81 | 82 |
| Aspergillus oryzae | 83 | 84 |
| Ajellomyces capsulatus NAm1 | 85 | 86 |

TABLE 2-continued

Fungal and plant 2Fe—2S DHADs in addition to those in Table 1

| Description | SEQ ID NO: Nucleic acid | SEQ ID NO: Peptide |
|---|---|---|
| Coccidioides immitis RS | 87 | 88 |
| Botryotinia fuckeliana B05.10 | 89 | 90 |
| Phaeosphaeria nodorum SN15 | 91 | 92 |
| Pichia guilliermondii ATCC 6260 | 95 | 96 |
| Debaryomyces hansenii CBS767 | 97 | 98 |
| Lodderomyces elongisporus NRRL YB-4239 | 99 | 100 |
| Vanderwaltozyma polyspora DSM 70294 | 109 | 110 |
| Ashbya gossypii ATCC 10895 | 115 | 116 |
| Laccaria bicolor S238N-H82 | 117 | 118 |
| Coprinopsis cinerea okayama7#130 | 119 | 120 |
| Cryptococcus neoformans var. neoformans JEC21 | 121 | 122 |
| Ustilago maydis 521 | 123 | 124 |
| Malassezia globosa CBS 7966 | 125 | 126 |
| Aspergillus clavatus NRRL 1 | 127 | 128 |
| Neosartorya fischeri NRRL 181 (Putative) | 129 | 130 |
| Aspergillus oryzae | 131 | 132 |
| Aspergillus niger (An18g04160) | 133 | 134 |
| Aspergillus terreus NIH2624 | 135 | 136 |
| Coccidioides immitis RS (CIMG_04591) | 137 | 138 |
| Paracoccidioides brasiliensis | 139 | 140 |
| Phaeosphaeria nodorum SN15 | 141 | 142 |
| Gibberella zeae PH-1 | 143 | 144 |
| Neurospora crassa OR74A | 145 | 146 |
| Coprinopsis cinerea okayama 7#130 | 147 | 148 |
| Laccaria bicolor S238N-H82 | 149 | 150 |
| Ustilago maydis 521 | 151 | 152 |

TABLE 3

Expression genes

| Description | SEQ ID NO: Nucleic acid | SEQ ID NO: Peptide |
|---|---|---|
| Roseburia inulinivorans (RdhtA) | 15 | 43 |
| Roseburia inulinivorans (RdhtB) | 16 | 44 |
| Bacillus subtilis (alsS) | 27 | 28 |
| Vibrio cholerae (KARI) | 35 | 36 |
| Pseudomonas aeruginosa PAO1 (KARI) | 37 | 38 |
| Pseudomonas fluorescens PF5 (KARI) | 39 | 40 |
| Achromobacter xylosoxidans (sadB) | 41 | 42 |
| B12-independent glycerol dehydratase from Clostridium butyricum | 190 | 191 |
| B-12 independent butanediol dehydratase reactivase from Clostridium butyricum | 192 | 193 |

SEQ ID NO:17 is a synthetic rdhtAB sequence.

SEQ ID NOs:18-21 and 30-33 are primers for PCR, cloning or sequencing analysis used a described in the Examples herein.

SEQ ID NO:22 is a dual terminator sequence.

SEQ ID NO:23 is the *Saccharomyces cerevisiae* ADH terminator.

SEQ ID NO:24 is the *Saccharomyces cerevisiae* CYC1 terminator.

SEQ ID NO:25 is the *Saccharomyces cerevisiae* FBA promoter.

SEQ ID NO:26 is the *Saccharomyces cerevisiae* GPM promoter.

SEQ ID NO:29 is the pNY13 vector.

SEQ ID NO:34 is the *Saccharomyces cerevisiae* CUP1 promoter.

SEQ ID NO:173 is the codon optimized coding region for ILV3 DHAD from *Kluyveromyces lactis*.

TABLE 4

Functionally verified DHADs used for Profile HMM

| Organism | SEQ ID NO: Nucleic acid | SEQ ID NO: Peptide |
|---|---|---|
| Nitrosomonas europaea ATCC 19718 | 174 | 175 |
| Synechocystis sp. PCC 6803 | 176 | 177 |
| Streptococcus mutans UA159 | 178 | 179 |
| Streptococcus thermophilus LMG 18311 | 180 | 181 |
| Ralstonia metallidurans CH34 | 182 | 183 |
| Ralstonia eutropha JMP134 | 184 | 185 |
| Lactococcus lactis subsp. cremoris SK11 | 186 | 187 |
| Flavobacterium johnsoniae UW101 | 188 | 189 |

DETAILED DESCRIPTION OF THE INVENTION

Disclosed herein is the discovery that introduced Fe—S containing proteins in yeast host cells have high activity levels when expression of endogenous Fe—S containing proteins is inhibited or disrupted. The present invention relates to recombinant yeast cells engineered to provide expression of at least one heterologous protein that is an Fe—S cluster protein, and engineered for reduced expression of at least one endogenous Fe—S cluster protein. In these cells the activity of the heterologous Fe—S cluster protein is improved, such that there is improved production of a product made in a biosynthetic pathway that includes the enzyme activity. Examples of commercially useful products from a pathway including an Fe—S protein include valine, isoleucine, leucine, pantothenic acid, iosbutanol, 2-butanone and 2-butanol.

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures;

through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value The term "Fe—S cluster protein" is a protein that binds an iron-sulfur cluster and requires the binding of the cluster for its activity.

The term "2Fe-2S DHAD" refers to DHAD enzymes requiring a bound $[2Fe-2S]^{2+}$ cluster for activity.

The term "Fe—S propanediol dehydratase reactivase" refers to propanediol dehydratase reactivases requiring a bound Fe—S cluster for activity.

The term "isobutanol biosynthetic pathway" refers to an enzyme pathway to produce isobutanol from pyruvate.

The term "2-butanol biosynthetic pathway" refers to an enzyme pathway to produce 2-butanol from pyruvate.

The term "2-butanone biosynthetic pathway" refers to an enzyme pathway to produce 2-butanone from pyruvate.

There term "Dihydroxy-acid dehydratase", also abbreviated DHAD, will refer to an enzyme that converts 2,3-dihydroxyisovalerate to α-ketoisovalerate.

The term "butanediol dehydratase", also known as "diol dehydratase" or "propanediol dehydratase" refers to a polypeptide (or polypeptides) having an enzyme activity that catalyzes the conversion of 2,3-butanediol to 2-butanone. Butanediol dehydratases that do not utilize the cofactor adenosyl cobalamin (also known as coenzyme B12, or vitamin B12; although vitamin B12 may refer also to other forms of cobalamin that are not coenzyme B12) are coenzyme B12-independent diol dehydratases that require association with a diol dehydratase reactivase that is a Fe—S cluster protein. Examples of B12-independent diol dehydratases include those from *Clostridium glycolicum* (Hartmanis et al. (1986) *Arch. Biochem. Biophys.* 245:144-152), *Clostridium butyricum* (protein SEQ ID NO:191; coding region SEQ ID NO:190; O'Brien et al. (2004) *Biochemistry* 43:4635-4645), and *Roseburia inulinivorans* (coding: SEQ ID NO:15; protein: SEQ ID NO:43; disclosed in co-pending US Patent Pub No. US20090155870.

The term "propanediol dehydratase reactivase", also known as "diol dehydratase reactivase" or "butanediol dehydratase reactivase" refers to a reactivating factor for diol dehydratase, an enzyme which undergoes suicide inactivation during catalysis. Diol dehydratase reactivases associated with coenzyme B12-independent diol dehydratases may be Fe—S cluster proteins. Examples include those from *Clostridium glycolicum* (Hartmanis et al. (1986) Arch. Biochem. Biophys. 245:144-152), *Clostridium butyricum* (protein SEQ ID NO:193; coding region SEQ ID NO:192; O'Brien et al. (2004) *Biochemistry* 43:4635-4645), and *Roseburia inulinivorans* (coding: SEQ ID NO:16; protein: SEQ ID NO:44; disclosed in commonly owned and co-pending US Patent Pub No. US20090155870).

The term "reduced expression" as it applies to the expression of a protein in a cell host will include those situations where the activity of the protein is diminished as compared with a wildtype form (as with antisense technology for example) or substantially eliminated as with gene disruption, deletion or inactivation for example.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any, gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in, a manner different than that found in nature. "Endogenous gene" refers to a native gene it its natural location in the genome of an organism. A "foreign gene" or "heterologous gene" refers to a gene not normally found in the host organism, but that is introduced into the host organism by gene transfer. "Heterologous gene" includes a native coding region, or portion thereof, that is reintroduced into the source organism in a form that is different from the corresponding native gene. For example, a heterologous gene may include a native coding region that is a portion of a chimeric gene including non-native regulatory regions that is reintroduced into the native host. Also a foreign gene can comprise native genes inserted into a non-native organism, or chimeric genes. A "transgene" is a gene that has been introduced into the genome by a transformation procedure.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA:

As used herein, an "isolated nucleic acid fragment" or "isolated nucleic acid molecule" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, 2$^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST™ (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLAST X (Altschul et al., *J. Mol. Biol.,* 215:403-410 (1990)); 3.) DNASTAR software (DNASTAR, Inc. Madison, Wis.); 4.) Sequencher software (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, Guide to Yeast Genetics and Molecular and Cell Biology (Part A, 2004, Christine Guthrie and Gerald R. Fink (Eds.), Elsevier Academic Press, San Diego, Calif.).

Discovery of Improved Fe—S Cluster Protein Activity in Yeast

Proteins that contain a bound iron-sulfur cluster (Fe—S) that is required for their activity may have low activity when used in heterologous expression systems. Formation of Fe—S clusters and their transfer to apo-proteins is a multistep process involving at least several proteins including cysteine desulfurase, a scaffold protein and a chaperone. Thus a heterologous Fe—S protein may not be effectively composed by the endogenous host system. Applicants have discovered a way to increase activity of an Fe—S protein expressed as a heterologous protein in a yeast host cell. Applicants have found that by reducing production of an endogenous Fe—S protein in the yeast host cell, an improvement in activity of an expressed heterologous Fe—S cluster protein can be achieved. Expression in yeast of either heterologous fungal or plant 2Fe-2S dihydroxy-acid dehydratase (DHAD) or Fe—S propanediol dehydratase reactivase (RdhtB) was improved when an endogenous gene encoding isopropylmalate dehydratase (LEU1) or an endogenous gene encoding dihydroxyacid dehydratase (ILV3) was inactivated in the yeast host cells.

In yeast host cells with inactivation of a gene encoding an endogenous Fe—S protein, the activity of the expressed heterologous Fe—S protein may be increased to at least about 1.4 fold of the activity in a yeast host cell with no inactivation of Fe—S protein encoding gene. For example, the *Kluyveromyces lactis* DHAD had 1.4 fold activity in a LEU1 deletion host as compared to a host without the deletion; the *Roseburia inulinivorans* RdhtB had 1.7 fold comparative activity in a LEU deletion host as measured by the activated RdhtA protein activity (described below); *Saccharomyces cerevisiae* DHAD expressed in the cytosol had 1.5 fold comparative activity in a mitochondrial ILV3 deletion host; and *Kluyveromyces lactis* DHAD expressed in the cytosol had 7.4 fold comparative activity in a mitochondrial ILV3 deletion host.

Yeast Host, Cells with Reduced Expression of Endogenous Fe—S Protein

Reduced endogenous Fe—S protein expression may be engineered in any yeast cell that is amenable to genetic manipulation. Examples include yeasts of *Saccharomyces, Schizosaccharomyces, Hansenula, Candida, Kluyveromyces, Yarrowia* and *Pichia*. Suitable strains include, but are not limited to, *Saccharomyces cerevisiae, Schizosaccharomyces pombe, Kluyveromyces lactis, Kluyveromyces thermotolerans, Candida glabrata, Candida albicans, Pichia stipitis* and *Yarrowia lipolytica*. Particularly suitable is *Saccharomyces cerevisiae*.

In any of these yeasts, any endogenous Fe—S protein may be a target for reduced expression. Fe—S proteins in yeast that may be targeted for reduced expression include, for example, the following proteins (with encoding gene): aconitase (ACO1), homoaconitase (LYS4), DHAD (ILV3), lipoate synthase (LIP5), biotin synthase (BIO2), ferredoxin maturation (YAH1), NADH ubiquinone oxidoreductase (NDI1), succinate dehydrogenase (SDH2), ubiquinol-cytochrome-c reductase (RIP1), isopropylmalate isomerase (LEU1), sulfite reductase (ECM17), glutamate dehydrogenase (GLT1), ABC protein Rli1 (RLI1), NTPase Nbp35 (NBP35), and hydrogenase-like protein (NARI1). Yeast cells with reduced expression of individual Fe—S proteins may require special conditions for growth such as supplementation of the growth medium with a particular nutrient, as is well known to one skilled in the art. For example, a strain with disruption of LEU1 is supplemented with leucine, a strain with disruption of DHAD is supplemented with leucine, isoleucine, and valine, and a strain with disruption of LYS4 is supplemented with lysine. Some strains with a disruption require no supplementation for growth. Particularly suitable Fe—S proteins that may be targeted for reduced expression include Isopropylmalate isomerase (LEU1), Dihydroxyacid dehydratase (ILV3), Sulfite reductase (ECM17), Glutamate dehydrogenase (GLT1), and Biotin synthase (BIO2). Reduced expression is engineered for at least one endogenous Fe—S protein, and two or more endogenous Fe—S proteins may be reduced.

LEU1 encodes isopropylmalate dehydratase, an enzyme belonging to EC 4.2.1.33 that is involved in branched chain amino acid biosynthesis, specifically synthesis of leucine. Any gene encoding an isopropylmalate dehydratase, which is an enzyme requiring a 4Fe-4S cluster for activity, may be inactivated in a yeast host cell of this disclosure. Examples of yeast LEU1 inactivation target genes and their encoded proteins are those from *Saccharomyces cerevisiae* (coding SEQ ID NO:1; protein SEQ ID NO:2), *Schizosaccharomyces pombe* (coding SEQ ID NO:3; protein SEQ ID NO:4), *Candida galbrata* strain CBS138 (coding SEQ ID NO:5; protein SEQ ID NO:6), *Candida albicans* SC5314 (coding SEQ ID NO:7; protein SEQ ID NO:8), *Kluyveromyces lactis* (coding SEQ ID NO: protein SEQ ID NO:10), *Yarrowia lipolytica* (coding SEQ ID NO:11; protein SEQ ID NO:12) and *Pichia stipitis* (coding SEQ ID NO:13: protein SEQ ID NO:14).

Similarly in any of the yeast hosts described herein, an endogenous ILV3 gene may be inactivated to reduce endogenous Fe—S protein expression. ILV3 encodes mitochondrial DHAD that is involved in branched chain amino acid biosynthesis. Mitochondrial DHAD is encoded by a nuclear gene, and has a mitochondrial targeting signal sequence so that it is transported to and localized in the mitochondrion. Any ILV3 gene may be inactivated in a yeast host cell of this disclosure. Examples of yeast ILV3 inactivation target genes and their encoded proteins are those from *Saccharomyces cerevisiae* YJM78 (coding SEQ ID NO:111; protein SEQ ID NO:112), *Schizosaccharomyces pombe* (coding SEQ ID NO:93; protein SEQ ID NO:94), *Candida galbrata* strain CBS138 (coding SEQ ID NO:107; protein SEQ ID NO:108), *Candida albicans* SC5314 (coding SEQ ID NO:101; protein SEQ ID NO:102), *Kluyveromyces lactis* (coding SEQ ID NO:113; protein SEQ ID NO:114), *Yarrowia lipolytica* (coding SEQ ID NO:105; protein SEQ ID NO:106) and *Pichia stipitis* CBS 6054 (coding SEQ ID NO:103; protein SEQ ID NO:104).

Because genes encoding isopropylmalate dehydratases and DHAD enzymes genes are well known, and because of the prevalence of genomic sequencing, additional suitable species of these enzymes can be readily identified by one skilled in the art on the basis of sequence similarity using bioinformatics approaches. Typically BLAST™ (described above) searching of publicly available databases with known isopropylmalate dehydratase amino acid sequences, such as those provided herein, is used to identify these enzymes and their encoding sequences that may be targeted for inactivation in the present strains. For example, endogenous yeast isopropylmalate dehydratase and DHAD proteins having amino acid sequence identities of at least about 70-75%, 75%-80%, 80-85%, 85%-90%, 90%-95% or 98% sequence identity to any of the isopropylmalate dehydratase proteins of SEQ ID NOs:2, 4, 6, 8, 10, 12 and 14 and the DHAD proteins of SEQ ID NOs:94, 102, 104, 106, 108, 112, and 114 may have reduced expression in the present strains. Identities are based on the Clustal W method of alignment using the default parameters of GAP PENALTY=10, GAP LENGTH PENALTY=0.1, and Gonnet 250 series of protein weight matrix.

Additionally, the sequences of LEU1 coding regions and ILV3 provided herein may be used to identify other homologs in nature. For example each of the coding regions described herein may be used to isolate genes encoding homologous proteins. Isolation of homologous genes using sequence-dependent protocols is well known in the art. Examples of sequence-dependent protocols include, but are not limited to: 1.) methods of nucleic acid hybridization; 2.) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci. USA* 82:1074 (1985); or strand displacement amplification (SDA), Walker, et al., *Proc. Natl. Acad. Sci. U.S.A.*, 89:392 (1992)]; and 3.) methods of library construction and screening by complementation.

For example, genes encoding similar proteins or polypeptides to the isopropylmalate dehydratase and DHAD encoding genes provided herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of the described sequences may be used in polymerase chain reaction protocols to amplify longer nucleic acid fragments encoding homologous genes from DNA or RNA. The polymerase chain reaction may also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence may be based upon sequences derived from the cloning vector. For example, the skilled artisan can follow the RACE protocol (Frohman et al., *PNAS USA* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *PNAS USA* 86:5673 (1989); Loh et al., *Science* 243:217 (1989)).

Alternatively, the provided isopropylmalate dehydratase and DHAD encoding sequences can be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and will depend upon the specific test to be done. Typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness and Chen, *Nucl. Acids Res.* 19:5143-5151 (1991)). Suitable chaotropic agents include guanidinium chloride, guanidinium thiocyanate, sodium thiocyanate, lithium tetrachloroacetate, sodium perchlorate, rubidium tetrachloroacetate, potassium iodide and cesium trifluoroacetate, among others. Typically, the chaotropic agent will be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL polymer (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

Protein and nucleic acid encoding sequences for any of the other Fe—S proteins that may be targeted for reduced activity in a yeast cell of the invention may be identified using bioinformatics and other methods well known to one skilled in the art. For example, aconitase sequences are identified by keyword searching in bioinformatics databases. Several sequences identified by this method are those from *Saccharomyces cerevisiae* (coding SEQ ID NO:153; protein SEQ ID NO:154), *Schizosaccharomyces pombe* on chromosome II (coding SEQ ID NO:155; protein SEQ ID NO:156), *Schizosaccharomyces pombe* on chromosome I (coding SEQ ID NO:157; protein SEQ ID NO:158), *Kluyveromyces lactis* (coding SEQ ID NO:15; protein SEQ ID NO:160), *Candida albicans* SC5314 (coding SEQ ID NO:161; protein SEQ ID NO:162), *Yarrowia lipolytica* (coding SEQ ID NO:163; protein SEQ ID NO:164), *Pichia stipitis* CBS 6054 (coding SEQ ID NO:165; protein SEQ ID NO:166), *Candida galbrata* CBS138 chromosome F (coding SEQ ID NO:167; protein SEQ ID NO:168), *Candida galbrata* CBS138 chromosome D (coding SEQ ID NO:169; protein SEQ ID NO:170), and *Candida galbrata* CBS138 chromosome K (coding SEQ ID NO:171; protein SEQ ID NO:172).

Genes encoding Fe—S proteins, for example LEU1, ILV3, or ACO1 may be disrupted in any yeast cell using genetic modification. Many methods for genetic modification of target genes are known to one skilled in the art and may be used to create the present yeast strains. Modifications that may be used to reduce or eliminate expression of a target protein are disruptions that include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed. In addition, expression of a gene may be blocked by expression of an antisense RNA or an interfering RNA, and constructs may be introduced that result in cosuppression. In addition, the synthesis or stability of the transcript may be lessened by mutation. Similarly the efficiency by which a protein is translated from mRNA may be modulated by mutation. All of these methods may be readily practiced by one skilled in the art making use of the known or identified coding sequences such as LEU1 or ILV3.

DNA sequences surrounding a LEU1, ILV3, or ACO1 coding sequence are also useful in some modification procedures and are available for yeasts such as for *Saccharomyces cerevisiae* in the complete genome sequence coordinated by Genome Project ID9518 of Genome Projects coordinated by NCBI (National Center for Biotechnology Information) with identifying GOPID 13838. Additional examples of yeast genomic sequences include that of *Yarrowia lipolytica*, GOPIC 13837, and of *Candida albicans*, which is included in GRID 10771, 10701 and 16373. Additional genomes have been completely sequenced and annotated and are publicly available for the following yeast strains *Candida glabrata* CBS 138, *Kluyveromyces lactis* NRRL Y-1140, *Pichia stipitis* CBS 6054, and *Schizosaccharomyces pombe* 972h-.

In particular, DNA sequences surrounding a target coding sequence, such as LEU1 or ILV3, are useful for modification methods using homologous recombination. For example, in this method flanking sequences are placed bounding a selectable marker gene to mediate homologous recombination whereby the marker gene replaces the target gene. Also partial target gene sequences and flanking sequences bounding a selectable marker gene may be used to mediate homologous recombination whereby the marker gene replaces a portion of the target gene. In addition, the selectable marker may be bounded by site-specific recombination sites, so that following expression of the corresponding site-specific recombinase, the resistance gene is excised from the target gene without reactivating the latter. The site-specific recombination leaves behind a recombination site which disrupts expression of the target gene encoded protein. The homologous recombination vector may be constructed to also leave a deletion in the target gene following excision of the selectable marker, as is well known to one skilled in the art.

Deletions may be made using mitotic recombination as described in Wach et al. ((1994) Yeast 10:1793-1808). This method involves preparing a DNA fragment that contains a selectable marker between genomic regions that may be as short as 20 bp, and which bound a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in Methods in Enzymology, v194, pp 281-301 (1991)).

Moreover, promoter replacement methods may be used to exchange the endogenous transcriptional control elements allowing another means to modulate expression such as described in Mnaimneh et al. ((2004) Cell 118(1):31-44) and in Example 12 herein.

In addition, a target gene in any yeast cell may be disrupted using random mutagenesis, which is followed by screening to identify strains with reduced target gene encided activity. Using this type of method, the DNA sequence of for example the LEU1, ILV3, or any other region of the genome affecting expression of a target Fe—S protein, need not be known.

Methods for creating genetic mutations are common and well known in the art and may be applied to the exercise of creating mutants. Commonly used random genetic modification methods (reviewed in *Methods in Yeast Genetics*, 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of yeast cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed in Spencer et al (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics*, 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al (Mutagenesis in Yeast, 1996, *Yeast Protocols: Methods in Cell and Molecular Biology*. Humana Press, Totowa, N.J.). Introduction of a mutator phenotype can also be used to generate random chromosomal mutations in yeast. Common mutator phenotypes can be obtained through disruption of one or more of the following genes: PMS1, MAG1, RAD18 or RAD51. Restoration of the non-mutator phenotype can be easily obtained by insertion of the wildtype allele. Collections of modified cells produced from any of these or other known random mutagenesis processes may be screened for reduced Fe—S protein activity.

Heterologous Fe—S Proteins

Any fungal or plant 2Fe-2S cluster dihydroxy-acid dehydratase (DHAD) and any Fe—S propanediol dehydratase reactivase may be expressed as a heterologous protein in a yeast host cell engineered as disclosed herein for reduced endogenous Fe—S cluster protein expression, and increased activity may be obtained. A heterologous protein includes one that is expressed in a manner differently from expression of a corresponding endogenous protein. For example in yeast, endogenous DHAD is encoded by ILV3 in the nucleus and the expressed DHAD protein has a mitochondrial targeting signal sequence such that the protein is localized in the mitochondrion. An Fe—S cluster is added to the DHAD protein in the mitochondrion for its activity in branched chain amino acid biosynthesis. It is desirable to express DHAD activity in the cytosol for participation in biosynthetic pathways that are localized in the cytosol. Cytosolic expression of DHAD in yeast is heterologous expression since the native protein is localized in the mitochondrion. For example, heterologous expression of the *Saccharomyces cerevisiae* DHAD in *S. cerevisiae* is obtained by expressing the *S. cerevisiae* DHAD coding region with the mitochondrial targeting signal removed, such that the protein remains in the cytosol. 2Fe-2S DHADs that may be used in the present disclosure include those from fungi and plants. Representative fungal or plant 2Fe-2S DHADs are listed in Tables 1 and 2. Fungal or plant 2Fe-2S DHADs with amino acid sequence identities of 95% or greater were removed from the analysis providing this list for simplification. However, any sequences with 95% or greater amino acid identities to any of these sequences are useful in the present invention. The analysis used to obtain 2Fe-2S DHADs is described in commonly owned and co-pending U.S. Patent Application 61/100,792, which is herein incorporated by reference. The analysis is as follows: Therein a Profile Hidden Markov Model (HMM) was prepared based on amino acid sequences of eight functionally verified DHADs. These DHADs are from *Nitrosomonas europaea* (DNA SEC) ID NO:174; Protein SEQ ID NO:175), *Synechocystis* sp. PCC6803 (DNA SEQ ID:176; Protein SEQ ID NO:177), *Streptococcus mutans* (DNA SEQ ID NO:178; Protein SEQ ID NO:179), *Streptococcus thermophilus* (DNA SEQ ID NO:180; protein SEQ ID No:181), *Ralstonia metallidurans* (DNA SEQ ID NO:182; protein SEQ ID NO:183), *Ralstonia eutropha* (DNA SEQ ID NO:184; protein SEQ ID NO:185), and *Lactococcus lactis* (DNA SEQ ID NO:186; protein SEQ ID NO:187). In addition the DHAD from *Flavobacterium johnsoniae* (DNA SEQ ID NO:188; protein SEQ ID NO:189) was found to have dihydroxy-acid dehydratase activity when expressed in *E. coli* and was used in making the Profile. The Profile HMM is prepared using the HMMER software package (The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences, given in Table 9.

Any protein that matches the Profile HMM with an E value of $<10^{-5}$ is a DHAD related protein, which includes 4Fe-4S DHADs, 2Fe-2S DHADs, arabonate dehydratases, and phosphogluconate dehydratases. Sequences matching the Profile HMM are then analyzed for the presence of the three conserved cysteines, corresponding to positions 56, 129, and 201 in the *Streptococcus mutans* DHAD. The presence of all three conserved cysteines is characteristic of proteins having a $[2Fe-2S]^{2+}$ cluster. Proteins having the three conserved cysteines include arabonate dehydratases and 2Fe-2S DHADs. The 2Fe-2S DHADs may be distinguished from the arabonate dehydratases by analyzing for signature conserved amino acids found to be present in the 2Fe-2S DHADs or in the arabonate dehydratases at positions corresponding to the following positions in the *Streptococcus mutans* DHAD amino acid sequence. These signature amino acids are in 2Fe-2S DHADs or in arabonate dehydratases, respectively, at the following positions (with greater than 90% occurrence): 88 asparagine vs glutamic acid; 113 not conserved vs glutamic acid; 142 arginine or asparagine vs not conserved; 165: not conserved vs glycine; 208 asparagine vs not conserved; 454 leucine vs not conserved; 477 phenylalanine or tyrosine vs not conserved; and 487 glycine vs not conserved.

The proteins identified by this process that have a fungal or plant origin, such as SEQ ID NOs:46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150 and 152 may be used in the present invention, as well as any protein with amino acid identity of at least about 95%, 96%, 97%, 98%, or 99% to any of these sequences. Particularly suitable is the DHAD from *Kluyveromyces lactis* (SEQ ID NO:114) and DHADs with at least about 90% amino acid sequence identity to SEQ ID NO:114 using the Clustal W method of alignment using the default parameters of GAP PENALTY=10, GAP LENGTH PENALTY=0.1, and Gonnet 250 series of protein weight matrix over the full length of the protein sequence.

In addition, fungal or plant 2Fe-2S DHADs that may be used in the present invention may be identified by their position in a fungal or plant 2Fe-2S DHAD branch of a phylogenetic tree of DHAD related proteins. In addition, 2Fe-2S DHADs that may be used may be identified using sequence comparisons with any of the fungal or plant 2Fe-2S DHADs whose sequences are provided herein, where sequence identity may be at least about 80%-85%, 85%-90%, 90%-95% or 95%-99%.

Additionally, the sequences of fungal or plant 2Fe-2S DHADs provided herein may be used to identify other homologs in nature. For example each of the DHAD encoding nucleic acid fragments given herein as SEQ ID NOs:45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 11, 121, 123, 125, 127, 129, 131, 133, 135, 137, 13, 141, 143, 145, 147, 149 and 151 may be used to isolate genes encoding homologous proteins as described above for the LEU1 coding region.

The coenzyme B12-independent propanediol deydratase reactivase of *Roseburia inulinivorans* is a protein requiring an Fe—S cluster for activity. This protein, RdhtB, is disclosed in co-pending US Patent Pub No. US20090155870, which is herein incorporated by reference. RdhtB reactivates a coenzyme B12-independent propanediol deydratase of *Roseburia inulinivorans*, which is named RdhtA and is also disclosed in commonly owned and co-pending US Patent Pub No. US20090155870. The activity of RdhtB may be assessed by assaying the activity of RdhtA, since RdhtB is required for RdhtA activity. Activity of RdhtB, and therefore of RdhtA, is improved by expressing in a yeast host with reduced endogenous Fe—S protein expression disclosed herein. Heterologous expression of any coenzyme B12-independent propanediol deydratase reactivase that requires an Fe—S cluster for activity may be improved in a yeast strain having reduced endogenous Fe—S protein expression. A coenzyme B12- independent propanediol deydratase reactivase may be readily identified by one skilled in the art by assessing propanediol deydratase activity of the associated propanediol deydratase enzyme in the presence or absence of coenzyme B12. An example is a diol dehydratase reactivase of *Clostridium butyricum* (coding region SEQ ID NO:192; protein SEQ ID NO:193).

Other coenzyme B12-independent propanediol deydratase reactivases that may be used may be identified through bioinformatics analysis of sequences as compared to that of RdhtB SEQ ID NO:44 by one skilled in the art. Proteins with coenzyme B12-independent propanediol deydratase reactivase activity and sequence identity to SEQ ID NO:44 of at least about 80%-85%, 85%-90%, 90%-95% or 95%-99% may be used. Particularly suitable are those that are at least about 90% identical to the amino acid sequence as set forth in SEQ ID NO:44 using the Clustal W method of alignment using the default parameters of GAP PENALTY=10, GAP LENGTH PENALTY=0.1, and Gonnet 250 series of protein weight matrix over the full length of the protein sequence.

In addition, other coenzyme B12-independent propanediol deydratase reactivase homologs that may be used may be identified using the RdhtB coding region (SEQ ID NO:16) by methods as described above for the LEU1 coding region.

Expression of Heterologous Fe—S Proteins

Expression is achieved by transforming with a sequence encoding an Fe—S protein. The coding region to be expressed may be codon optimized for the target host cell, as well known to one skilled in the art. Methods for gene expression in yeast are known in the art (see for example *Methods in Enzymology*, Volume 194, *Guide to Yeast Genetics and Molecular and Cell Biology* (Part A, 2004, Christine Guthrie and Gerald R. Fink (Eds.), *Elsevier Academic Press*, San Diego, Calif.). Expression of genes in yeast typically requires a promoter, operably linked to a coding region of interest, and a transcriptional terminator. A number of yeast promoters can be used in constructing expression cassettes for genes in yeast, including, but not limited to promoters derived from the following genes: CYC1, HIS3, GAL1, GAL10, ADH1, PGK, PHO5, GAPDH, ADC1, TRP1, URA3, LEU2, ENO, TPI, CUP1, FBA, GPD, GPM, and AOX1. Suitable transcriptional terminators include, but are not limited to FBAt, GPDt, GPMt, ERG10t, GAL1t, CYC1, and ADH1.

Suitable promoters, transcriptional terminators, and coding regions may be cloned into *E. coli*-yeast shuttle vectors, and transformed into yeast cells. These vectors allow strain propagation in both *E. coli* and yeast strains. Typically the vector used contains a selectable marker and sequences allowing autonomous replication or chromosomal integration in the desired host. Typically used plasmids in yeast are shuttle vectors pRS423, pRS424, pRS425, and pRS426 (American Type Culture Collection, Manassas, Va.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding the described Fe—S protein coding regions may be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≧21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Any coding regions expressed in the present yeast cells may be codon optimized for expression in the specific host yeast cell being engineered as is well known to one skilled in the art. For example, for expression of the *K. lactis* and *P. stipitis* ILV3 coding regions in *S. cerevisiae*, each was codon optimized for *S. cerevisiae* expression in Example 1 herein.

Product Biosynthesis with Improved Heterologous Fe—S Protein Activity

Production of any product that has an Fe—S protein contributing to its biosynthetic pathway may benefit from the improved activity disclosed herein of a heterologous expressed Fe—S protein in a yeast host with reduced endogenous Fe—S protein expression. For example, DHAD provides a step in pathways for biosynthesis of isobutanol, and RdhtB contributes to a biosynthetic pathway to produce 2-butanone or 2-butanol.

Biosynthetic pathways including a step performed by DHAD for synthesis of isobutanol are disclosed in commonly owned and co-pending US Patent Application publication US 20070092957 A1, which is herein incorporated by reference. A diagram of the disclosed isobutanol biosynthetic pathways is provided in FIG. 1. Production of isobutanol in a strain disclosed herein benefits from increased DHAD activity. As described in US Patent Pub No. US20070092957 A1, steps in an example isobutanol biosynthetic pathway include conversion of:

pyruvate to acetolactate (FIG. 1 pathway step a) as catalyzed for example by acetolactate synthase;
acetolactate to 2,3-dihydroxyisovalerate (FIG. 1 pathway step b) as catalyzed for example by acetohydroxy acid isomeroreductase;
2,3-dihydroxyisovalerate to α-ketoisovalerate (FIG. 1 pathway step c) as catalyzed for example by acetohydroxy acid dehydratase also called DHAD;
α-ketoisovalerate to isobutyraldehyde (FIG. 1 pathway step d) as catalyzed for example by branched-chain α-keto acid decarboxylase; and
isobutyraldehyde to isobutanol (FIG. 1 pathway step e) as catalyzed for example by branched-chain alcohol dehydrogenase.

The substrate to product conversions, and enzymes involved in these reactions, for steps f, g, h, I, j, and k of alternative pathways are described in US 20070092957 A1.

Genes that may be used for expression of the enzymes for the isobutanol pathways are described in US 20070092957 A1, and additional genes that may be used can be identified by one skilled in the art through bioinformatics or experimentally as described above. The preferred use in all three pathways of ketol-acid reductoisomerase (KARI) enzymes with particularly high activities are disclosed in commonly owned and co-pending US Patent Pub No. US20080261230. Examples of high activity KARIs disclosed therein are those from *Vibrio cholerae* (DNA: SEQ ID NO:35; protein SEQ ID NO:36), *Pseudomonas aeruginosa* PA01, (DNA: SEQ ID NO:37; protein SEQ ID NO:38), and *Pseudomonas fluorescens* PF5 (DNA: SEQ ID NO:39; protein SEQ ID NO:40).

Additionally described in US 20070092957 A1 are construction of chimeric genes and genetic engineering of yeast, exemplified by *Saccharomyces cerevisiae*, for isobutanol production using the disclosed biosynthetic pathways.

Figure 2:
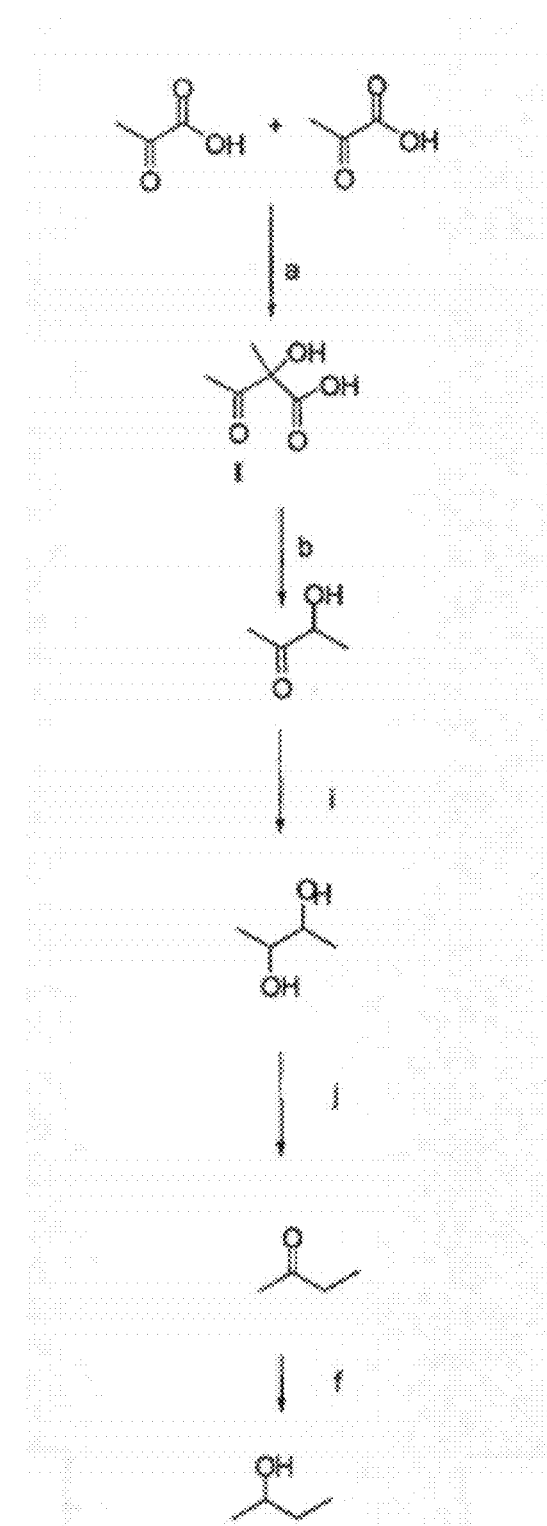
FIG. 2 shows a biosynthetic pathway for 2-butanone and 2-butanol production.

A biosynthetic pathway including propanediol dehydratase for synthesis of 2-butanone and 2-butanol is disclosed in commonly owned and co-pending US Patent Pub No. US20070292927A1, which is herein incorporated by reference. A diagram of the disclosed 2-butanone and 2-butanol biosynthetic pathway is provided in FIG. 2. 2-Butanone is the product made when the last depicted step of converting 2-butanone to 2-butanol is omitted. Production of 2-butanone or 2-butanol in a strain disclosed herein benefits from increased coenzyme 812-independent propanediol dehydratase reactivase activity. As described in US Patent Pub No. US20070292927A1, steps in the disclosed biosynthetic pathway include conversion of:

pyruvate to acetolactate (FIG. 2 step a) as catalyzed for example by acetolactate synthase;
acetolactate to acetoin (FIG. 2 step b) as catalyzed for example by acetolactate decarboxylase;
acetoin to 2,3-butanediol (FIG. 2 step i) as catalyzed for example by butanediol dehydrogenase;
2,3-butanediol to 2-butanone (FIG. 2 step j) as catalyzed for example by diol dehydratase glycerol dehydratase, or propanediol dehydratase; and
2-butanone to 2-butanol (FIG. 2 step f) as catalyzed for example by butanol dehydrogenase.

Genes that may be used for expression of these enzymes are described in US Patent Pub No. US20070292927A1. The use in this pathway in yeast of the butanediol dehydratase from *Roseburia inulinivorans*, RdhtA, (protein SEQ ID NO:43, coding region SEQ ID NO:15) is disclosed in commonly owed and co-pending US Patent Pub No. US20090155870. This enzyme is used in conjunction with the butanediol dehydratase reactivase from *Roseburia inulinivorans*, RdhtB, (protein SEQ ID NO:44, coding region SEQ ID NO:16). This butanediol dehydratase is desired in many hosts because it does not require coenzyme $B_{12}$.

Additionally described in US Patent Pub No. US20090155870 are construction of chimeric genes and genetic engineering of yeast for 2-butanol production using the US 20070292927A1 disclosed biosynthetic pathway.

Fermentation Media

Yeasts disclosed herein may be grown in fermentation media for production of a product having an Fe—S protein as part of the biosynthetic pathway. Fermentation media must contain suitable carbon substrates. Suitable substrates may include but are not limited to monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate may also be one-carbon substrates such as carbon dioxide, or methanol for which metabolic conversion into key biochemical intermediates has been demonstrated. In addition to one and two carbon substrates methylotrophic organisms are also known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., *Microb. Growth C1 Compd.*, [Int. Symp.], 7th (1993), 415-32. Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, preferred carbon substrates are glucose, fructose, and sucrose.

In addition to an appropriate carbon source, fermentation media must contain suitable minerals, salts, cofactors, buffers and other components, known to those skilled in the art, suitable for the growth of the cultures and promotion of the enzymatic pathway necessary for production of the desired product.

Culture Conditions

Typically cells are grown at a temperature in the range of about 20° C. to about 37° C. in an appropriate medium. Suitable growth media in the present invention are common commercially prepared media such as broth that includes yeast nitrogen base, ammonium sulfate, and dextrose as the carbon/energy source) or YPD Medium, a blend of peptone, yeast extract, and dextrose in optimal proportions for growing most *Saccharomyces cerevisiae* strains. Other defined or synthetic growth media may also be used and the appropriate medium for growth of the particular microorganism will be known by one skilled in the art of microbiology or fermentation science.

Suitable pH ranges for the fermentation are between pH 3.0 to pH 7.5, where pH 4.5.0 to pH 6.5 is preferred as the initial condition.

Fermentations may be performed under aerobic or anaerobic conditions, where anaerobic or microaerobic conditions are preferred.

The amount of butanol produced in the fermentation medium can be determined using a number of methods known in the art, for example, high performance liquid chromatography (HPLC) or gas chromatography (GC).

Industrial Batch and Continuous Fermentations

The present process employs a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

The present invention may be practiced using either batch, fed-batch or continuous processes and known modes of fermentation are suitable. Additionally, it is contemplated that cells may be immobilized on a substrate as whole cell catalysts and subjected to fermentation conditions for 1-butanol production.

Methods for Butanol Isolation from the Fermentation Medium

Bioproduced butanol may be isolated from the fermentation medium using methods known in the art. For example, solids may be removed from the fermentation medium by centrifugation, filtration, decantation, or the like. Then, the butanol may be isolated from the fermentation medium, which has been treated to remove solids as described above, using methods such as distillation, liquid-liquid extraction, or membrane-based separation. Because butanol forms a low boiling point, azeotropic mixture with water, distillation can only be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see for example Doherty and Malone, *Conceptual Design of Distillation Systems*, McGraw Hill, New York, 2001).

The butanol-water mixture forms a heterogeneous azeotrope so that distillation may be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase may be returned to the first distillation column as reflux. The butanol-rich decanted organic phase may be further purified by distillation in a second distillation column.

The butanol may also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption may also be used to isolate butanol from the fermentation medium. In this method, the fermentation broth containing the butanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, J., Fritsch, E. F. and Maniatis, T, Molecular Cloning: A Laboratory Manual; Cold Spring Harbor Laboratory Press: Cold Spring Harbor, N.Y. (1989) (Maniatis) and by T. J. Silhavy, M. L. Bennan, and L. W. Enquist, *Experiments with Gene Fusions*, Cold Spring Harbor Laboratory Press, Cold Spring Harbor, N.Y. (1984) and by Ausubel, F. M. et al., *Current Protocols in Molecular Biology*, pub. by Greene Publishing Assoc. and Wiley-Interscience (1987), and by *Methods in Yeast Genetics*, 2005, Cold Spring Harbor Laboratory Press, Cold Spring Harbor, N.Y.

Materials and Methods suitable for the maintenance and growth of bacterial cultures are well known in the art. Techniques suitable for use in the following Examples may be found as set out in *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, eds), American Society for Microbiology, Washington, D.C. (1994)) or by Thomas D. Brock in *Biotechnology: A Textbook of Industrial Microbiology*, Second Edition, Sinauer Associates, Inc., Sunderland, Mass. (1989). All reagents, restriction enzymes and materials used for the growth and maintenance of microbial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.) unless otherwise specified. Microbial strains were obtained from The American Type Culture Collection (ATCC), Manassas, Va., unless otherwise noted. All the oligonucleotide primers were synthesized by Sigma-Genosys (Woodlands, Tex.) or Integrated DNA Technologies (Coralsville, Iowa).

Synthetic complete medium is described in Amberg, Burke and Strathern, 2005, Methods in Yeast Genetics, Cold Spring Harbor Laboratory Press, Cold Spring Harbor, N.Y.

HPLC

Analysis for fermentation by-product composition is well known to those skilled in the art. For example, one high performance liquid chromatography (HPLC) method utilizes a SHODEX SH-1011 column with a SHODEX SH-G guard column (both available from Waters Corporation, Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol retention time is 47.6 minutes.

The meaning of abbreviations is as follows: "s" means second(s), "min" means minute(s), "h" means hour(s), "psi" means pounds per square inch, "nm" means nanometers, "d" means day(s), "µL" means microliter(s), "mL" means milliliter(s), "L" means liter(s), "mm" means millimeter(s), "nm" means nanometers, "mM" means millimolar, "M" means molar, "mmol" means millimole(s), "µmol" means micromole(s)", "g" means gram(s), "µg" means microgram(s) and "ng" means nanogram(s), "PCR" means polymerase chain reaction, "OD" means optical density, "$OD_{600}$," means the optical density measured at a wavelength of 600 nm, "kDa" means kilodaltons, "g" means the gravitation constant, "bp" means base pair(s), "kbp" means kilobase pair(s), "% w/v" means weight/volume percent, % v/v" means volume/volume percent, "wt %" means percent by weight, "HPLC" means high performance liquid chromatography, and "GC" means gas chromatography. The term "molar selectivity" is the number of moles of product produced per mole of sugar substrate consumed and is reported as a percent.

Example 1

Expression of DHAD from *K. lactis* in LEU1 Deletion Strain of *S. cerevisiae*

The yeast LEU1 gene encodes isopropylmalate dehydratase, an enzyme that requires an Fe—S cluster for its function. The impact of LEU1 deletion on DHAD activity expressed from the *Kluyveromyces lactis* DHAD coding region was examined in this example. For gene expression in yeast, the shuttle vector pNY13 (SEQ ID NO:29) derived from pRS423 was used. This shuttle vector contained an F1 origin of replication (1423 to 1879) for maintenance in *E. coli* and a 2 micron origin (nt 7537 to 8881) for replication in yeast. The vector has an FBA promoter (nt 2111 to 3110) and FBA terminator (nt 4316 to 5315). In addition, it carries the HIS3 marker (nt 504 to 1163) for selection in yeast and ampicillin resistance marker (nt 6547 to 7404) for selection in *E. coli*. pNY9 is the same vector with a URA3 marker replacing the HIS3 marker.

The ILV3 coding region for DHAD from *Kluyveromyces lactis* was synthesized with codon-optimization for expression in *S. cerevisiae* by DNA 2.0 (Menlo Park, Calif.). The cloned synthesized sequence was PCR amplified. During amplification, a portion of the mitochondrial signal peptide for the DHAD at the N-terminus was deleted by using ilv3 (K)(0)-F(delet) as the forward primer with ilv3(K)(o)-R as the reverse primer, resulting in a coding region for cytoplasmic expression (SEQ ID NO:173). In addition, an SphI site was incorporated in the forward primer, while a NotI site was included in the reverse primer. The PCR product was cloned into the shuttle vectors pNY9 and pNY13 so that the ILV3 coding region was under the control of the FBA promoter. Both PCR product and each vector (pNY9, pNY13) were digested with SphI and NotI. After digestion, the components were ligated, and the ligation mixture was transformed into TOP10 competent cells (Invitrogen). Transformants were selected in LB agar plates supplemented with 100 µg/ml of ampicillin. Positive clones were screened by PCR with the forward and reverse primers described above. The resulting plasmids were designated as pRS423::FBAp-ILV3(KL) and pRS426::FBAp-ILV3(KL), derived from plasmids pNY13 and pNY9, respectively.

To study the expression of the DHAD from *K. lactis* in *S. cerevisiae* the expression vector pRS423::FBAp-ILV3(KL) along with an empty vector pRS426 were transformed into strains BY4743 and BY4743 leu1::kanMX4 (ATCC 4034377). The competent cell preparation and transformation were based on the Frozen Yeast Transformation kit from Zymo Research. The transformants were selected on agar plates with yeast synthetic medium lacking histidine and uracil (Teknova). For enzymatic assays, the strains carrying the expression construct and the empty vector pRS426 were first grown overnight in 5 ml synthetic complete yeast medium lacking histidine and uracil. The 5 ml overnight cultures were transferred into 100 ml of medium in a 250 ml flask. The cultures were harvested when they reached 1 to 2 O.D. at 600 nm. The samples were washed with 10 ml of 20 mM Tris (pH 7.5) and then resuspended in 1 ml of the same Tris buffer. The samples were transferred into 2.0 ml tubes containing 0.1 mm silica (Lysing Matrix B, MP biomedicals). The cells were then broken in a bead-beater (BIO101). The supernatant was obtained by centrifugation in a microfuge at 13,000 rpm at 4° C. for 30 minutes. Typically, 0.06 to 0.1 mg of crude extract protein was used in a DHAD assay. Protein in the crude extracts was determined by Bradford assay with Coomassie stain.

Dihydroxy-Acid Dehydratase Enzyme Assay

The in vitro DHAD enzyme assay is a variation on the assay described in Flint et al. (J. Biol. Chem. (1993) 268: 14732-14742.). The assay was performed in a 1.6 ml total volume and consisted of: 800 µl 2× buffer (100 mM Tris pH 8.0, 20 mM $MgCl_2$), 160 µl 10× substrate (15.6 mg/ml dihydroxyisovalerate), crude extract (typically 50-200 µg protein), and water. The reaction was incubated at 37° C. At 0, 30, 60, and 90 minute time intervals, 350 µl aliquots of the reaction were removed and incubated with 350 µl of 0.05% dinitrophenyhydrazine in 1N HCl for 30 minutes at 25° C. To quench the reaction, 350 µl of 4N sodium hydroxide was added to the reaction mixture, and the reaction was centrifuged at 15,000×g for 2 minutes. The supernatant was transferred to a plastic disposable cuvette and absorbance at 540 nm was measured in a spectrophotometer. The amount of α-ketoisovalerate (HIV) produced was determined by entering the absorbance into the linear regression equation obtained from a standard curve of α-ketoisovalerate. The amount of KIV produced at each time point was plotted to determine the rate of production. The slope of the linear regression was then used to calculate specific activity using the formula:

Specific activity calculation=(slope of KIV production/1000)/mg protein per 1.6 mL reaction=mmol/min*mg The dehydratase from *K. lactis* had a specific activity in the range of 0.2 to 0.35 µmol min$^{-1}$ mg$^{-1}$ when expressed in yeast strain BY4743 (Δleu1). In contrast, this enzyme had a specific activity in the range of only 0.14 µmol min$^{-1}$ mg$^{-1}$ when expressed in the parent yeast strain BY4743. Strains BY4743 (Δleu1) and wildtype BY4743 containing empty vectors pRS423 or pRS426 had a background of activity in the range of 0.03 to 0.1 µmol min$^{-1}$ mg$^{-1}$.

Example 2

Expression of Diol Dehydratase in LEU1 Deletion Strain of *S. cerevisiae*

A coenzyme B12-independent propanediol dehydratase is disclosed in commonly owned and co-pending US Patent Pub No. US20090155870. The sequences encoding this coenzyme B12-independent (S-adenosylmethionine (SAM)-dependent) propanediol dehydratase (SEQ ID NO:15) and its putative associated reactivase (SEQ ID NO:16) in the bacterium *Roseburia inulinivorans* [Scott et al. (2006) *J. Bacteriol.* 188:4340-9], hereafter referred to as rdhtA and rdhtB, respectively, were synthesized as one DNA fragment (SEQ ID NO:17) by standard methods and cloned into an *E. coli* vector (by DNA2.0, Inc., Menlo Park, Calif.). This clone was used as a PCR template to prepare separate RdhtA and RdhtB coding region fragments. The RdhtA coding region for the diol dehydratase was amplified by PCR using primers N695 and N696 (SEQ ID NOs:18 and 19). The RdhtB coding region for the diol dehydratase activase, was amplified by PCR using primers N697 and N698 (SEQ ID NOs:20 and 21). The two DNA fragments were combined with a dual terminator DNA fragment (SEQ ID NO:22) that has an ADH terminator (SEQ ID NO:23) and a CYC1 terminator (SEQ ID NO:24) adjacent to each other in opposing orientation using SOE PCR (Horton et al. (1989) Gene 77:61-68). The dual terminator fragment was isolated as a 0.6 kb fragment following PacI digestion of pRS426::FBA-ILV5+GPM-kivD (described in co-owned and co-pending US Patent Publication 20070092957 A1, Example 17). The resulting 4 kb DNA fragment had the RdhtA and RdhtB coding regions in opposing orientation on either side of the dual terminator, with the 3' end of each coding region adjacent to the dual terminator sequence. This DNA fragment was then cloned by gap repair methodology (Ma et al. (1987) Genetics 58:201-216) into the *S. cerevisiae* shuttle vector pRS426::FBA-ILV5+GPM-kivD that was prepared by digestion with BbvCI to remove the ILV5 and kivD coding regions and dual terminator sequence between their 3' ends. The resulting plasmid, pRS426::RdhtAB (below), contained the RdhtA gene under the control of the *S. cerevisiae* FBA promoter (SEQ ID NO:25) and the RdhtB gene under control of the *S. cerevisiae* GPM promoter (SEQ ID NO:26).

Plasmids pRS426 and pRS426::RdhtAB were introduced into *S. cerevisiae* strains BY4743 (ATCC 201390) and BY4743 leu1:kanMX4 (ATCC 4034377) by standard techniques (*Methods in Yeast Genetics*, 2005, Cold Spring Harbor Laboratory Press, Cold Spring Harbor, N.Y., pp. 201-202). Cells were plated on synthetic complete medium lacking uracil to select for transformants. Transformants were tested for diol dehydratase activity using an in vivo assay as follows. Patched cells grown on solid medium were used to inoculate liquid media (20 ml) in petri plates. Media used were synthetic complete minus uracil with and without addition of 5 g/L 1,2-propanediol 9Aldrich Cat. No. 398039). The petri plates were transferred to an Anaeropack™ System jar (Mitsubishi Gas Chemical Co. Cat. No. 50-70). An anaerobic environment (<0.1% oxygen) was generated using PACK-ANAERO sachets (Mitsubishi Gas Chemical Co. Cat. No. 10-01). After 48 hours, culture supernatants were sampled, filtered and analyzed by HPLC as described in General Methods. Propanol, which has a retention time of 38.8 minutes, was observed in culture supernatants of strains carrying pRS426::RdhtAB when 1,2-propanediol was provided in the medium. The results given in Table 5 show that more propanol was produced in the supernatants of the strain also carrying the LEU1 deletion than in the strain without the LEU1 deletion. Statistical analysis gave a P score of less than 0.0005.

TABLE 5

Propanol production with propanediol dehydratase/reactivase expression in yeast with and without LEU1 knockout.

| Strain | 1,2-propanediol Added | Propanol Peak Area |
|---|---|---|
| BY4743 Δleu1::kanMX4/pRS426::RdhtAB | 5 g/L | 19472 ± 1403 (n = 6) |
| BY4743 Δleu1::kanMX4/pRS426::RdhtAB | 0 g/L | 2478 (n = 1) |
| BY4743/pRS426::RdhtAB | 5 g/L | 11830 ± 1963 (n = 6) |
| BY4743/pRS426::RdhtAB | 0 g/L | 2369 (n = 1) |
| BY4743 Δleu1::kanMX4/pRS426 | 5 g/L | 2633 (n = 1) |
| BY4743/pRS426 | 5 g/L | 2841 (n = 1) |

Example 3

Improving Cytosolic Dihydroxy-Acid Dehydratase (DHAD) Activity in *S. cerevisiae* Through a Disruption of Mitochondrial ILV3

Vector/Host Construction

In *S. cerevisiae* ILV3 encodes the mitochondrial dihydroxy-acid dehydratase that is involved in branched chain amino acid biosynthesis. To reduce background from endogenous ILV3 expression for in vitro enzymatic assays in *S. cerevisiae*, an ilv3::URA3 disruption cassette was constructed by PCR amplification of the URA3 marker from pRS426 (ATCC No. 77107) with primers "ILV3::URA3 F" and "ILV3::URA3 R", given as SEQ ID NO:30 and 31. These primers produced a 1.4 kb URA3 PCR product that contained 70 bp 5' and 3' extensions identical to sequences upstream and downstream of the ILV3 chromosomal locus for homologous recombination. The PCR product was transformed into BY4741 cells (ATCC 201388) using standard genetic techniques (*Methods in Yeast Genetics*, 2005, Cold Spring Harbor Laboratory Press, Cold Spring Harbor, N.Y., pp. 201-202) and resulting transformants were maintained on synthetic complete media lacking uracil and supplemented with 2% glucose at 30° C. Transformants were screened by PCR using primers "ILV3 F Check" and "URA3 REV Check", given as SEQ ID NOs:32 and 33, to verify integration at the correct site and disruption of the endogenous ILV3 locus. The correct transformants had the genotype: BY4741 ilv3::URA3.

Construction of plasmid pRS423::FBAp-ILV3(KL) and pRS426::FBAp-ILV3(KL) were described in Example 1. Construction of pRS423::CUP1-alsS+FBA-ILV3 has been described in co-owned and co-pending US Patent Publication US20070092957 A1, Example 17 which is herein incorporated by reference. pRS423::CUP1-alsS+FBA-ILV3 is the same plasmid as pRS423::CUP1p-alsS-FBAp-ILV3. This construction contains a chimeric gene containing the S. cerevisiae CUP1 promoter (SEQ ID NO:34), alsS coding region from Bacillus subtilis (SEQ ID NO:27), and CYC1 terminator (SEQ ID NO:24); and also a chimeric gene containing the S. cerevisiae FBA promoter (SEQ ID NO:25), ILV3 coding region from S. cerevisiae lacking the mitochondrial targeting signal coding sequence (SEQ ID NO:111) and ADH1 terminator (SEQ ID NO:23).

Preparation of Samples

Plasmid vectors pRS423::CUP1p-alsS-FBAp-IL V3 and pRS423::FBAp-ILV3(KL) were transformed into strain BY4741 ilv3::URA3 using standard genetic techniques (*Methods in Yeast Genetics*, 2005, Cold Spring Harbor Laboratory Press, Cold Spring Harbor, N.Y.) and maintained on synthetic complete media lacking histidine. Plasmid vectors pRS423::CUP1p-alsS-FBAp-ILV3 and pRS426::FBAp-ILV3(KL) were also transformed into strain BY4741. Aerobic cultures were grown in 1000 ml flasks containing 200 ml synthetic complete media lacking histidine and supplemented with 2% glucose in an INNOVA 4000 incubator (New Brunswick Scientific, Edison, N.J.) at 30° C. and 225 rpm. Cultures were harvested at $OD_{600}$ measurements of 1.0-2.0 and pelleted by centrifugation at 6000×g for 10 minutes. Cell pellets were washed with 10 mM Tris-HCl, pH 8.0 and pellets were stored at −80° C. until assayed for activity. Cell free extracts were prepared by standard bead beating method using 1 ml of 0.5 mm beads and 1.5 ml of yeast cell suspension. Protein concentration in the extracts was determined by Bradford assay with Coomassie stain. DHAD enzyme assays and specific activity calculations were performed as described in Example 1. The results given in Table 6 show that there was higher DHAD activity in the ILV3 deletion cells than in cells without the ILV3 deletion.

TABLE 6

DHAD activity in yeast with and without ILV3 deletion.

| Strain | Specific Activity (µmol/min*mg) | Average Specific Activity (µmol/min*mg) |
|---|---|---|
| BY4741 | 0.018 | 0.013 |
| | 0.014 | |
| | 0.008 | |
| BY4741 pRS423::CUP1p-alsS-FBAp-ILV3 | 0.018 | 0.019 |
| | 0.020 | |
| BY4741 pRS426::FBAp-ILV3(KL) | 0.040 | 0.038 |
| | 0.036 | |
| BY4741 ilv3::URA3 | 0.00006 | 0.00041 |
| | 0.00075 | |
| BY4741 ilv3::URA3 pRS423::CUP1p-alsS-FBAp-ILV3 | 0.030 | 0.029 |
| | 0.028 | |
| BY4741 ilv3::URA3 pRS423::FBAp-ILV3(KL) | 0.317 | 0.281 |
| | 0.244 | |

Verification of Alpha-Ketoisovalerate Formation by HPLC

Formation of alpha-ketoisovalerate from the in vitro DHAD enzyme assays was accomplished using HPLC and semicarbizide derivatization. DHAD enzyme assays were performed in a 1.6 ml total volume and consisted of: 800 µl 2× buffer (100 mM Tris pH 8.0, 20 mM $MgCl_2$), 160 µl 10× substrate (15.6 mg/ml dihydroxyisovalerate), crude extract (typically 50-200 µg protein), and water. The reactions were incubated at 37° C. At time intervals of zero and 90 minutes 350 µl aliquots of the reactions were removed, transferred to ice, and centrifuged at 13,000×g for 2 minutes at 4° C. to remove precipitated protein. The supernatants were transferred to ice-chilled MICROCON YM-10 (Sigma) spin columns and centrifuged at 13,000×g for 20 minutes at 4° C. to remove enzymes and soluble proteins. The flowthroughs were mixed with 100 µl derivatizing reagent (1% semicarbizide hydrochloride and 1.5% sodium acetate trihydrate) and incubated at room temperature for 15 minutes. The reactions were spun through COSTAR spin filters (CoStar, 0.22 µm filter) at 13,000×g for 5 minutes at 4° C. to remove any precipitates. The flowthroughs were transferred to HPLC vials for analysis.

Analysis of derivatized alpha-ketoisovalerate was conducted using reverse phase chromatography on a SUPELCOSIL LC-18 column with SUPELGUARD LC-18-DB guard column (Supelco; 25 cm×4.6 mm, 5 µm). Injection volumes were 10 µl. Mobile phases were methanol (A) and 50 mM NaOAc pH 7.2. The gradient program utilized is given in Table 7, with detection at 250 nm.

TABLE 7

Gradient used for derivatized alpha-ketoisovalerate HPLC assay

| Time (min) | Flow (ml/min) | % NaOAc (50 mM) | % MEOH | Curve |
|---|---|---|---|---|
| Initial | 1.0 | 95 | 5 | |
| 5 | 1.0 | 95 | 5 | 6 |
| 20 | 1.0 | 70 | 30 | 6 |
| 21 | 1.0 | 0 | 100 | 6 |
| 25 | 1.0 | 0 | 100 | 6 |
| 26 | 1.0 | 95 | 5 | 6 |
| 35 | 1.0 | 95 | 5 | 6 |

The retention time of semicarbizide-derivatized alpha-ketoisovalerate was 11.5 minutes.

The results, which are given in Table 8, confirmed that KIV was produced in the cells, as detected in the indirect assay for specific activity above. The amount of KIV listed in the DHAD Assay column is the amount determined indirectly in the 90 min sample for the activity assay described above in determining the specific activity. This amount of KIV correlates well with the amount detected in the HPLC assay.

TABLE 8

Comparison of KIV detected in DHAD activity assay and by HPLC.

| | keto-isovalerate production (µM) | |
|---|---|---|
| Strain | DHAD Assay | HPLC |
| BY4741 ilv3::URA3 pRS423::FBAp-ILV3(KL) | 256 | 256 |
| BY4741 ilv3::URA3 pRS423::FBAp-ILV3(KL) | 162 | 163 |

TABLE 9

| | | | | | | | | | | | | | |
|---|---|---|---|---|---|---|---|---|---|---|---|---|---|
| HMMER2.0 [2.2g] | | | | | | | | | | | Program name and version | | |
| NAME dhad_for_hmm | | | | | | | | | | | Name of the input sequence alignment file | | |
| LENG 564 | | | | | | | | | | | Length of the alignment: include indels | | |
| ALPH Amino | | | | | | | | | | | Type of residues | | |
| MAP yes | | | | | | | | | | | Map of the match states to the columns of the alignment | | |
| COM /app/public/hmmer/current/bin/hmmbuild-F dhad-exp_hmm dhad_for_hmm.aln | | | | | | | | | | | Commands used to generate the file: this one means that hmmbuild (default patrameters) was applied to the alignment file | | |
| COM /app/public/hmmer/current/bin/hmmcalibrate dhad-exp_hmm | | | | | | | | | | | Commands used to generate the file: this one means that hmmcalibrate (default parameters) was applied to the hmm profile | | |
| NSEQ 8 | | | | | | | | | | | Number of sequences in the alignment file | | |
| DATE Tue Jun 3 10:48:24 2008 | | | | | | | | | | | When was the file generated | | |
| XT -8455 -4 -1000 -1000 -8455 -4 -8455 -4 | | | | | | | | | | | | | |
| NULT -4 -8455 | | | | | | | | | | | The transition probability distribution for the null model (single G state) | | |
| NULE 595 -1558 85 338 -294 453 -1158 197 249 902 -1085 -142 -21 -313 45 531 201 384 -199 | | | | | | | | | | | The symbol emission probability distribution for the null model (G state), consists of K (e.g. 4 or 20) integers. The null probability used to convert these back to model probabilities is 1/K. | | |
| EVD -499.650970 0.086142 | | | | | | | | | | | The extreme value distribution parameters μ and lambda respectively; both floating point values. Lambda is positive and nonzero. These values are set when the model is calibrated with hmmcalibrate. | | |

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| | -538 | * | -1684 | | | | | | | | | | | | | | | | | | |
| 1(M) | -233 | -1296 | 99 | 1223 | -1477 | -1132 | 89 | -1122 | 420 | -1248 | 1757 | 1553 | -1296 | 464 | -24 | -190 | -188 | -838 | -1578 | -985 | 6 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | -538 | * | | | | | | | | | | | | |
| 2(E) | -220 | -1288 | 232 | 1356 | -1807 | 1016 | -70 | -1474 | 190 | -1584 | -775 | 132 | -1298 | 300 | -282 | -183 | 1140 | -1092 | -1872 | -1262 | 7 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | * | * | | | | | | | | | | | | |
| 3(K) | -448 | -1932 | 1558 | 658 | -2220 | -1048 | 40 | -1983 | 1569 | -1938 | -1091 | 1558 | -1319 | 450 | -193 | -278 | -419 | -1552 | -2121 | -1397 | 8 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | * | * | | | | | | | | | | | | |
| 4(V) | -404 | -498 | -1497 | -939 | -588 | -1810 | -640 | 1591 | 914 | -127 | 335 | -962 | -1866 | -562 | -767 | -868 | -357 | 1720 | -1169 | -763 | 9 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | * | * | | | | | | | | | | | | |
| 5(E) | -265 | -1340 | -52 | 1376 | -1572 | -1189 | 113 | -1125 | 1345 | -1287 | -496 | 99 | -1321 | 505 | 198 | -218 | -205 | 597 | -1598 | -1032 | 10 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | * | * | | | | | | | | | | | | |
| 6(S) | 256 | -397 | -1014 | -830 | -1841 | -646 | -862 | -1443 | -767 | -1740 | -963 | -568 | -1249 | -651 | -1007 | 2267 | 1586 | -862 | -2080 | -1672 | 11 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -29 | -6203 | -7245 | -894 | -1115 | -701 | -1378 | * | * | | | | | | | | | | | | |
| 7(M) | -990 | -889 | -2630 | 157 | -513 | -2514 | -1346 | 1309 | -1767 | 820 | 3683 | -1898 | -2491 | -1496 | -1799 | -1589 | -925 | 150 | -1336 | -1041 | 12 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -16 | -7108 | -8150 | -894 | -1115 | -701 | -1378 | * | * | | | | | | | | | | | | |
| 8(E) | 588 | -1875 | -194 | 1536 | -2188 | -1373 | -59 | -1931 | 957 | -1890 | -977 | 904 | 292 | 393 | -162 | 483 | -372 | -1495 | -2070 | -1391 | 13 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -16 | -7108 | -8150 | -894 | -1115 | -701 | -1378 | * | * | | | | | | | | | | | | |
| 9(N) | -514 | -1116 | 1207 | -315 | 447 | -1650 | -304 | -778 | -224 | 825 | -277 | 1457 | -1738 | -123 | -618 | -627 | -454 | -603 | -1186 | 763 | 14 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -16 | -7108 | -8150 | -894 | -1115 | -701 | -1378 | * | * | | | | | | | | | | | | |

TABLE 9-continued

| | | | | | | | | | | | | | | | | | | |
|---|---|---|---|---|---|---|---|---|---|---|---|---|---|---|---|---|---|---|
| 10(N) | -815<br>-149<br>-16 | -1190<br>-500<br>-7108 | -1360<br>233<br>-8150 | -922<br>43<br>-894 | -904<br>-381<br>-1115 | -1967<br>399<br>-701 | -797<br>106<br>-1378 | -442<br>-626<br>* | -670<br>210<br>* | 381<br>-466 | 1700<br>-720 | 3009<br>275 | -2099<br>394 | -654<br>45 | -934<br>96 | -1051<br>359 | -791<br>117 | -445<br>-369 | -1490<br>-294 | -979<br>-249 | 15 |
| 11(K) | -1530<br>-149<br>-16 | -2498<br>-500<br>-7108 | -1722<br>233<br>-8150 | -855<br>43<br>-894 | -3141<br>-381<br>-1115 | -2246<br>399<br>-701 | -428<br>106<br>-1378 | -2627<br>-626<br>* | 2828<br>210<br>* | -2404<br>-466 | -1656<br>-720 | -927<br>275 | 662<br>394 | -2<br>45 | 2047<br>96 | -1421<br>359 | -1337<br>117 | -2324<br>-369 | -2357<br>-294 | -2081<br>-249 | 16 |
| 12(Y) | -872<br>-149<br>-16 | -1887<br>-500<br>-7108 | -861<br>233<br>-8150 | -290<br>43<br>-894 | -1369<br>-381<br>-1115 | -1801<br>399<br>-701 | 1662<br>106<br>-1378 | -1797<br>-626<br>* | 325<br>210<br>* | -1793<br>-466 | -1031<br>-720 | 893<br>275 | -1876<br>394 | 56<br>45 | 2219<br>96 | -812<br>359 | -780<br>117 | -1514<br>-369 | -1565<br>-294 | 2287<br>-249 | 17 |
| 13(S) | -830<br>-149<br>-16 | -1586<br>-500<br>-7108 | -1471<br>233<br>-8150 | -1099<br>43<br>-894 | -2717<br>-381<br>-1115 | -1642<br>399<br>-701 | -1010<br>106<br>-1378 | -2479<br>-626<br>* | -266<br>210<br>* | -2518<br>-466 | -1746<br>-720 | -1065<br>275 | -2069<br>394 | -676<br>45 | 1822<br>96 | 2748<br>359 | -1000<br>117 | -1950<br>-369 | -2597<br>-294 | -2189<br>-249 | 18 |
| 14(Q) | -851<br>-149<br>-16 | -2131<br>-500<br>-7108 | -775<br>233<br>-8150 | -153<br>43<br>-894 | -2554<br>-381<br>-1115 | -1735<br>399<br>-701 | -211<br>106<br>-1378 | -2205<br>-626<br>* | 1908<br>210<br>* | -2094<br>-466 | -1244<br>-720 | -386<br>275 | -1802<br>394 | 2254<br>45 | 974<br>96 | 1001<br>359 | -747<br>117 | -1819<br>-369 | -2181<br>-294 | -1667<br>-249 | 19 |
| 15(T) | -405<br>-149<br>-16 | -1258<br>-500<br>-7108 | -618<br>233<br>-8150 | -100<br>43<br>-894 | -1490<br>-381<br>-1115 | -1466<br>399<br>-701 | 1158<br>106<br>-1378 | -1121<br>-626<br>* | 1<br>210<br>* | -1299<br>-466 | -514<br>-720 | 578<br>275 | -1607<br>394 | 65<br>45 | -433<br>96 | 960<br>359 | 1849<br>117 | 343<br>-369 | -1677<br>-294 | -1143<br>-249 | 20 |
| 16(I) | -1772<br>-149<br>-16 | -1325<br>-500<br>-7108 | -4307<br>233<br>-8150 | -3877<br>43<br>-894 | -1405<br>-381<br>-1115 | -3993<br>399<br>-701 | -3383<br>106<br>-1378 | 2935<br>-626<br>* | -3705<br>210<br>* | 820<br>-466 | -217<br>-720 | -3632<br>275 | -3761<br>394 | -3400<br>45 | -3682<br>96 | -3260<br>359 | -1742<br>117 | 2033<br>-369 | -2838<br>-294 | -2525<br>-249 | 21 |
| 17(T) | -1018<br>-149<br>-16 | -1329<br>-500<br>-7108 | -2004<br>233<br>-8150 | -1771<br>43<br>-894 | -409<br>-381<br>-1115 | -1993<br>399<br>-701 | -1000<br>106<br>-1378 | -1256<br>-626<br>* | -1512<br>210<br>* | -1464<br>-466 | -966<br>-720 | -1543<br>275 | -2367<br>394 | -1428<br>45 | -1638<br>96 | -1257<br>359 | 3050<br>117 | -1090<br>-369 | -1012<br>-294 | 2448<br>-249 | 22 |
| 18(Q) | -1509<br>-149<br>-16 | -3056<br>-500<br>-7108 | 1970<br>233<br>-8150 | 44<br>43<br>-894 | -3310<br>-381<br>-1115 | -1666<br>399<br>-701 | -896<br>106<br>-1378 | -3242<br>-626<br>* | -877<br>210<br>* | -3158<br>-466 | -2439<br>-720 | -322<br>275 | -2123<br>394 | 3562<br>45 | -1493<br>96 | -1259<br>359 | -1550<br>117 | -2779<br>-369 | -3260<br>-294 | -2446<br>-249 | 23 |
| 19(D) | -1006<br>-149<br>-16 | -2199<br>-500<br>-7108 | 2178<br>233<br>-8150 | -88<br>43<br>-894 | -3159<br>-381<br>-1115 | 1997<br>399<br>-701 | -936<br>106<br>-1378 | -2974<br>-626<br>* | -948<br>210<br>* | -2977<br>-466 | -2174<br>-720 | -382<br>275 | -1960<br>394 | -589<br>45 | -1571<br>96 | 1295<br>359 | -1157<br>117 | -2369<br>-369 | -3178<br>-294 | -2430<br>-249 | 24 |
| 20(M) | 445<br>-149<br>-16 | -796<br>-500<br>-7108 | -1082<br>233<br>-8150 | -521<br>43<br>-894 | -841<br>-381<br>-1115 | -1643<br>399<br>-701 | -412<br>106<br>-1378 | -403<br>-626<br>* | -370<br>210<br>* | -692<br>-466 | 2213<br>-720 | -646<br>275 | 536<br>394 | 1166<br>45 | -698<br>96 | -630<br>359 | 660<br>117 | 831<br>-369 | -1204<br>-294 | -767<br>-249 | 25 |
| 21(Q) | 741<br>-149<br>-16 | -990<br>-500<br>-7108 | -1025<br>233<br>-8150 | -507<br>43<br>-894 | -1249<br>-381<br>-1115 | -1551<br>399<br>-701 | -519<br>106<br>-1378 | -720<br>-626<br>* | -357<br>210<br>* | -1062<br>-466 | -345<br>-720 | -635<br>275 | -1739<br>394 | 1770<br>45 | -713<br>96 | -589<br>359 | 1576<br>117 | 1129<br>-369 | -1559<br>-294 | -1097<br>-249 | 26 |
| 22(R) | -1753<br>-149<br>-16 | -2648<br>-500<br>-7108 | -2072<br>233<br>-8150 | -1047<br>43<br>-894 | -3365<br>-381<br>-1115 | -2405<br>399<br>-701 | -452<br>106<br>-1378 | -2782<br>-626<br>* | 1989<br>210<br>* | -2495<br>-466 | -1773<br>-720 | -1062<br>275 | -2379<br>394 | 2402<br>45 | 2643<br>96 | -1629<br>359 | -1506<br>117 | -2504<br>-369 | -2397<br>-294 | -2190<br>-249 | 27 |
| 23(S) | -330<br>-149<br>-16 | -1010<br>-500<br>-7108 | -1820<br>233<br>-8150 | -1628<br>43<br>-894 | -2778<br>-381<br>-1115 | -1229<br>399<br>-701 | -1652<br>106<br>-1378 | -2481<br>-626<br>* | -1592<br>210<br>* | -2691<br>-466 | -1841<br>-720 | -1273<br>275 | 2130<br>394 | -1426<br>45 | -1834<br>96 | 2449<br>359 | 1034<br>117 | -1716<br>-369 | -2961<br>-294 | -2594<br>-249 | 28 |
| 24(P) | 1882<br>-149<br>-16 | -1119<br>-500<br>-7108 | -2231<br>233<br>-8150 | -2302<br>43<br>-894 | -3062<br>-381<br>-1115 | -1360<br>399<br>-701 | -2209<br>106<br>-1378 | -2710<br>-626<br>* | -2339<br>210<br>* | -3013<br>-466 | -2243<br>-720 | -1676<br>275 | 3304<br>394 | -2117<br>45 | -2409<br>96 | -742<br>359 | -918<br>117 | -1916<br>-369 | -3263<br>-294 | -3022<br>-249 | 29 |
| 25(N) | 969<br>-149<br>-16 | -1230<br>-500<br>-7108 | -1066<br>233<br>-8150 | -915<br>43<br>-894 | -2593<br>-381<br>-1115 | -1313<br>399<br>-701 | -1196<br>106<br>-1378 | -2242<br>-626<br>* | -1033<br>210<br>* | -2447<br>-466 | -1626<br>-720 | 3197<br>275 | -1850<br>394 | -898<br>45 | -1392<br>96 | -582<br>359 | 1155<br>117 | -1644<br>-369 | -2736<br>-294 | -2256<br>-249 | 30 |
| 26(R) | -1847<br>-149<br>-16 | -2640<br>-500<br>-7108 | -2014<br>233<br>-8150 | -1161<br>43<br>-894 | -3282<br>-381<br>-1115 | -2428<br>399<br>-701 | -579<br>106<br>-1378 | -2818<br>-626<br>* | 687<br>210<br>* | -2553<br>-466 | -1869<br>-720 | -1165<br>275 | -2462<br>394 | 2447<br>45 | 3181<br>96 | -1746<br>359 | -1630<br>117 | -2555<br>-369 | -2447<br>-294 | -2228<br>-249 | 31 |

TABLE 9-continued

| | | | | | | | | | | | | | | | | | | | |
|---|---|---|---|---|---|---|---|---|---|---|---|---|---|---|---|---|---|---|---|
| 27(A) | 3048 -149 -16 | -932 -500 -7108 | -2480 233 -8150 | -2533 43 -894 | -3075 -381 -1115 | -1200 399 -701 | -2274 106 -1378 | -2765 -626 * | -2501 210 * | -3071 -466 | -2221 -720 | -1658 275 | -1948 394 | -2205 45 | -2512 96 | 1225 359 | -739 117 | -1842 -369 | -3322 -294 | -3078 -249 | 32 |
| 28(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 33 |
| 29(Y) | -1674 -149 -16 | -1506 -500 -7108 | -2863 233 -8150 | -2464 43 -894 | 596 -381 -1115 | -2872 399 -701 | 2251 106 -1378 | -972 -626 * | -2024 210 * | 2197 -466 | -552 -720 | -1986 275 | -2876 394 | -1739 45 | -1988 96 | -1987 359 | -1601 117 | -1002 -369 | -95 -294 | 2332 -249 | 34 |
| 30(Y) | -2013 -149 -16 | -2305 -500 -7108 | -2428 233 -8150 | -1781 43 -894 | -328 -381 -1115 | -2709 399 -701 | -654 106 -1378 | -2240 -626 * | -258 210 * | -2064 -466 | -1626 -720 | -1631 275 | -2788 394 | -899 45 | 2789 96 | -2017 359 | -1896 117 | -2130 -369 | -857 -294 | 3434 -249 | 35 |
| 31(A) | 2822 -149 -16 | -1031 -500 -7108 | -2418 233 -8150 | -2539 43 -894 | -3226 -381 -1115 | 1898 399 -701 | -2364 106 -1378 | -2941 -626 * | -2626 210 * | -3229 -466 | -2379 -720 | -1722 275 | -2026 394 | -2302 45 | -2634 96 | -654 359 | -848 117 | -1983 -369 | -3415 -294 | -3226 -249 | 36 |
| 32(I) | -1247 -149 -16 | -941 -500 -7108 | -3569 233 -8150 | -3039 43 -894 | -1082 -381 -1115 | -3101 399 -701 | -2185 106 -1378 | 2227 -626 * | -2763 210 * | 766 -466 | -76 -720 | -2700 275 | -3050 394 | -2469 45 | -2697 96 | -2253 359 | 1322 117 | 1974 -369 | -1988 -294 | -1633 -249 | 37 |
| 33(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 38 |
| 34(F) | -1511 -149 -16 | -1236 -500 -7108 | -3511 233 -8150 | -3017 43 -894 | 2747 -381 -1115 | -2982 399 -701 | -1069 106 -1378 | -260 -626 * | -2651 210 * | 992 -466 | 2737 -720 | -2407 275 | -2904 394 | -2088 45 | -2418 96 | -2099 359 | -1434 117 | -489 -369 | -537 -294 | 2056 -249 | 39 |
| 35(Q) | -576 -149 -16 | -1869 -500 -7108 | -401 233 -8150 | 92 43 -894 | -2232 -381 -1115 | 831 399 -701 | -173 106 -1378 | -1930 -626 * | 1505 210 * | -1913 -466 | -1042 -720 | -186 275 | -1620 394 | 1653 45 | -51 96 | -482 359 | 1346 117 | -1534 -369 | -2098 -294 | -1490 -249 | 40 |
| 36(D) | -1352 -149 -16 | -3066 -500 -7108 | 3028 233 -8150 | 1349 43 -894 | -3303 -381 -1115 | -1566 399 -701 | -724 106 -1378 | -3141 -626 * | 1155 210 * | -3043 -466 | -2267 -720 | -165 275 | -1991 394 | -354 45 | -1350 96 | -1086 359 | -1368 117 | -2659 -369 | -3221 -294 | -2356 -249 | 41 |
| 37(E) | -1507 -149 -16 | -3288 -500 -7108 | 2042 233 -8150 | 2762 43 -894 | -3520 -381 -1115 | 515 399 -701 | -853 106 -1378 | -3401 -626 * | -981 210 * | -3296 -466 | -2566 -720 | -182 275 | -2064 394 | -503 45 | -1753 96 | -1209 359 | -1553 117 | -2895 -369 | -3486 -294 | -2547 -249 | 42 |
| 38(D) | -1445 -149 -16 | -2778 -500 -7108 | 3529 233 -8150 | -53 43 -894 | -3524 -381 -1115 | -1590 399 -701 | -1129 106 -1378 | -3476 -626 * | -1367 210 * | -3459 -466 | -2774 -720 | -396 275 | -2156 394 | -825 45 | -2122 96 | 554 359 | -1609 117 | -2880 -369 | -3582 -294 | -2717 -249 | 43 |
| 39(F) | -2658 -149 -16 | -2176 -500 -7108 | -4213 233 -8150 | -4000 43 -894 | 3815 -381 -1115 | -3933 399 -701 | -1352 106 -1378 | -531 -626 * | -3638 210 * | 1121 -466 | -19 -720 | -3184 275 | -3709 394 | -2820 45 | -3296 96 | -3219 359 | -2579 117 | -1037 -369 | -601 -294 | 403 -249 | 44 |
| 40(D) | -684 -149 -16 | -2193 -500 -7108 | 1738 233 -8150 | 1460 43 -894 | -2494 -381 -1115 | -1437 399 -701 | -249 106 -1378 | -2257 -626 * | 1694 210 * | -2199 -466 | -1308 -720 | -62 275 | -1637 394 | 185 45 | -450 96 | -531 359 | 633 117 | -1808 -369 | -2374 -294 | -1657 -249 | 45 |
| 41(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | 3784 210 * | -3387 -466 | -2839 -720 | -2048 275 | -3039 394 | -1260 45 | -465 96 | -2604 359 | -2536 117 | -3331 -369 | -3001 -294 | -2988 -249 | 46 |
| 42(P) | 1882 -149 -16 | -1119 -500 -7108 | -2231 233 -8150 | -2302 43 -894 | -3062 -381 -1115 | -1360 399 -701 | -2209 106 -1378 | -2710 -626 * | -2339 210 * | -3013 -466 | -2243 -720 | -1676 275 | -3304 394 | -2117 45 | -2409 96 | -742 359 | -918 117 | -1916 -369 | -3263 -294 | -3022 -249 | 47 |
| 43(I) | -1006 -149 -16 | -992 -500 -7108 | -2347 233 -8150 | -1784 43 -894 | -650 -381 -1115 | -2452 399 -701 | -1256 106 -1378 | 2372 -626 * | -1386 210 * | 77 -466 | 2213 -720 | -1720 275 | -2455 394 | 2030 45 | -1490 96 | -1528 359 | -946 117 | 106 -369 | -1441 -294 | -1111 -249 | 48 |

TABLE 9-continued

| | | | | | | | | | | | | | | | | | | |
|---|---|---|---|---|---|---|---|---|---|---|---|---|---|---|---|---|---|---|
| 44(V) | −1771 −149 −16 | −1603 −500 −7108 | −3750 233 −8150 | −3689 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 49 |
| 45(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 50 |
| 46(I) | −1759 −149 −16 | −1303 −500 −7108 | −4330 233 −8150 | −3968 43 −894 | −1751 −381 −1115 | −4051 399 −701 | −3743 106 −1378 | 3027 −626 * | −3837 210 * | −597 −466 | −528 −720 | −3729 275 | −3875 394 | −3688 45 | −3910 96 | −3369 359 | −1751 117 | 2438 −369 | −3259 −294 | −2819 −249 | 51 |
| 47(V) | 1736 −149 −16 | −1012 −500 −7108 | −3546 233 −8150 | −3078 43 −894 | −1377 −381 −1115 | −3073 399 −701 | −2434 106 −1378 | 2052 −626 * | −2843 210 * | −608 −466 | −331 −720 | −2754 275 | −3122 394 | −2619 45 | −2855 96 | −2270 359 | −1277 117 | 2193 −369 | −2333 −294 | −1941 −249 | 52 |
| 48(N) | −686 −149 −16 | −1511 −500 −7108 | −702 233 −8150 | −806 43 −894 | −2927 −381 −1115 | −1386 399 −701 | −1339 106 −1378 | −2841 −626 * | −1264 210 * | −2950 −466 | −2137 −720 | 2702 275 | −1979 394 | −1062 45 | −1648 96 | 2444 359 | −971 117 | −2105 −369 | −3054 −294 | −2475 −249 | 53 |
| 49(M) | −411 −149 −16 | −857 −500 −7108 | −1800 233 −8150 | −1434 43 −894 | −1528 −381 −1115 | 1914 399 −701 | −1202 106 −1378 | −1029 −626 * | −1247 210 * | −1347 −466 | 2989 −720 | −1217 275 | −1912 394 | −1119 45 | −1444 96 | −676 359 | 1550 117 | −767 −369 | −1922 −294 | −1539 −249 | 54 |
| 50(W) | −782 −149 −16 | −1258 −500 −7108 | 793 233 −8150 | −683 43 −894 | 1193 −381 −1115 | 346 399 −701 | 2051 106 −1378 | −932 −626 * | −556 210 * | −1092 −466 | −441 −720 | −798 275 | −1993 394 | −426 45 | −909 96 | −904 359 | −720 117 | −779 −369 | 3163 −294 | 1546 −249 | 55 |
| 51(W) | 1009 −149 −16 | −798 −500 −7108 | −1470 233 −8150 | −935 43 −894 | −463 −381 −1115 | −1773 399 −701 | −545 106 −1378 | −460 −626 * | −751 210 * | −736 −466 | −66 −720 | −943 275 | −1904 394 | −606 45 | −1002 96 | 1604 359 | −507 117 | −322 −369 | 2535 −294 | 1521 −249 | 56 |
| 52(D) | −1137 −149 −16 | −2711 −500 −7108 | 2125 233 −8150 | 1647 43 −894 | −2995 −381 −1115 | −1523 399 −701 | −617 106 −1378 | −2786 −626 * | −528 210 * | −2743 −466 | −1933 −720 | −150 275 | −1897 394 | −234 45 | −1165 96 | −924 359 | 2117 117 | −2331 −369 | −2948 −294 | −2141 −249 | 57 |
| 53(I) | −599 −149 −16 | −1102 −500 −7108 | −1031 233 −8150 | −829 43 −894 | −1522 −381 −1115 | 1429 399 −701 | −927 106 −1378 | 2119 −626 * | −880 210 * | −1369 −466 | −699 −720 | 1692 275 | −1938 394 | −759 45 | −1188 96 | −799 359 | −698 117 | −689 −369 | −1887 −294 | −1419 −249 | 58 |
| 54(T) | −666 −149 −16 | −1412 −500 −7108 | −954 233 −8150 | −984 43 −894 | −2702 −381 −1115 | −1428 399 −701 | −1357 106 −1378 | −2418 −626 * | −1208 210 * | −2650 −466 | −1886 −720 | 2293 275 | −2000 394 | −1101 45 | −1519 96 | −787 359 | 2967 117 | −1835 −369 | −2866 −294 | −2360 −249 | 59 |
| 55(P) | −632 −149 −16 | −1230 −500 −7108 | −2074 233 −8150 | −2144 43 −894 | −2996 −381 −1115 | −1453 399 −701 | −2116 106 −1378 | −2631 −626 * | −2128 210 * | −2928 −466 | −2213 −720 | −1658 275 | 3610 394 | −2006 45 | −2221 96 | −852 359 | 1302 117 | −1931 −369 | −3185 −294 | −2917 −249 | 60 |
| 56(C) | −2476 −149 −16 | 5735 −500 −7108 | −4102 233 −8150 | −4358 43 −894 | −3712 −381 −1115 | −2763 399 −701 | −3545 106 −1378 | −3518 −626 * | −4167 210 * | −3859 −466 | −3569 −720 | −3631 275 | −3363 394 | −4030 45 | −3832 96 | −2793 359 | −2860 117 | −3158 −369 | −3464 −294 | −3718 −249 | 61 |
| 57(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 62 |
| 58(M) | 672 −149 −16 | −918 −500 −7108 | −3119 233 −8150 | −2578 43 −894 | −742 −381 −1115 | −2668 399 −701 | −1734 106 −1378 | 1807 −626 * | −2263 210 * | 16 −466 | 3713 −720 | −2271 275 | −2704 394 | −1960 45 | −2216 96 | −1806 359 | −1058 117 | 493 −369 | −1612 −294 | −1306 −249 | 63 |
| 59(H) | −1525 −149 −16 | −2164 −500 −7108 | −1235 233 −8150 | −1346 43 −894 | −2509 −381 −1115 | 2296 399 −701 | −3262 106 −1378 | −3172 −626 * | −1516 210 * | −3178 −466 | −2523 −720 | −1448 275 | −2541 394 | −1520 45 | −1760 96 | −1591 359 | −1741 117 | −2656 −369 | −2681 −294 | −2065 −249 | 64 |
| 60(L) | −2478 −149 −16 | −2009 −500 −7108 | −4717 233 −8150 | −4196 43 −894 | −568 −381 −1115 | −4424 399 −701 | −3262 106 −1378 | 1334 −626 * | −3887 210 * | 2824 −466 | 604 −720 | −4085 275 | −3872 394 | −3088 45 | −3590 96 | −3717 359 | −2380 117 | −199 −369 | −2217 −294 | −2207 −249 | 65 |

TABLE 9-continued

| | | | | | | | | | | | | | | | | | | | |
|---|---|---|---|---|---|---|---|---|---|---|---|---|---|---|---|---|---|---|---|
| 61(H) | −682 −149 −16 | −2191 −500 −7108 | 1015 233 −8150 | 275 43 −894 | −2485 −381 −1115 | 396 399 −701 | 2379 106 −1378 | −2251 −626 * | 62 210 * | −2197 −466 | −1307 −720 | 1826 275 | −1636 394 | 1527 45 | −480 96 | −529 359 | −641 117 | −1803 −369 | −2375 −294 | −1654 −249 | 66 |
| 62(D) | −575 −149 −16 | −1920 −500 −7108 | 1979 233 −8150 | 184 43 −894 | −2299 −381 −1115 | 94 399 −701 | −242 106 −1378 | −2029 −626 * | 114 210 * | −2023 −466 | −1144 −720 | −120 275 | −1608 394 | 186 45 | 1063 96 | −469 359 | 1413 117 | −1605 −369 | −2229 −294 | −1561 −249 | 67 |
| 63(L) | −2618 −149 −16 | −2139 −500 −7108 | −4597 233 −8150 | −4163 43 −894 | 2144 −381 −1115 | −4285 399 −701 | −2334 106 −1378 | −83 −626 * | −3854 210 * | 2690 −466 | 538 −720 | −3771 275 | −3806 394 | −2950 45 | −3488 96 | −3563 359 | −2505 117 | −751 −369 | −1442 −294 | −808 −249 | 68 |
| 64(A) | 2657 −149 −16 | −1033 −500 −7108 | −2408 233 −8150 | −2532 43 −894 | −3233 −381 −1115 | 2193 399 −701 | −2364 106 −1378 | −2950 −626 * | −2626 210 * | −3237 −466 | −2386 −720 | −1719 275 | −2027 394 | −2301 45 | −2635 96 | −655 359 | −850 117 | −1988 −369 | −3420 −294 | −3231 −249 | 69 |
| 65(K) | −443 −149 −16 | −1857 −500 −7108 | 958 233 −8150 | 270 43 −894 | −2158 −381 −1115 | −1393 399 −701 | −66 106 −1378 | −1890 −626 * | 1839 210 * | −442 −466 | −957 −720 | −36 275 | −1499 394 | 1204 45 | −132 96 | 616 359 | −382 117 | −1469 −369 | −2048 −294 | −1383 −249 | 70 |
| 66(C) | 605 −149 −16 | 1553 −500 −7108 | 739 233 −8150 | −17 43 −894 | −1374 −381 −1115 | −1488 399 −701 | −182 106 −1378 | 260 −626 * | 969 210 * | −203 −466 | −397 −720 | −263 275 | −1573 394 | 159 45 | 691 96 | −426 359 | −331 117 | −761 −369 | −1567 −294 | −1032 −249 | 71 |
| 67(A) | 2327 −149 −16 | −956 −500 −7108 | −3193 233 −8150 | −2728 43 −894 | −1289 −381 −1115 | −2677 399 −701 | −2114 106 −1378 | 1664 −626 * | −2485 210 * | −601 −466 | −288 −720 | −2403 275 | −2839 394 | −2263 45 | −2523 96 | −1871 359 | −1126 117 | 1617 −369 | −2143 −294 | −1765 −249 | 72 |
| 68(K) | −532 −149 −16 | −1656 −500 −7108 | −490 233 −8150 | 1321 43 −894 | −1891 −381 −1115 | −1527 399 −701 | −172 106 −1378 | −124 −626 * | 2206 210 * | −1591 −466 | −782 −720 | −223 275 | −1619 394 | 237 45 | −106 96 | −482 359 | −464 117 | −98 −369 | −1904 −294 | −1326 −249 | 73 |
| 69(H) | 384 −149 −16 | −1854 −500 −7108 | 936 233 −8150 | 889 43 −894 | −2165 −381 −1115 | −1363 399 −701 | 1498 106 −1378 | −1909 −626 * | 1111 210 * | −1866 −466 | −948 −720 | 1091 275 | −1464 394 | 421 45 | −131 96 | −284 359 | −342 117 | −69 −369 | −2043 −294 | −1364 −249 | 74 |
| 70(G) | 1823 −149 −16 | −932 −500 −7108 | −2330 233 −8150 | −2313 43 −894 | −3120 −381 −1115 | 2511 399 −701 | −2158 106 −1378 | −2865 −626 * | −2331 210 * | −3098 −466 | −2209 −720 | −1563 275 | −1912 394 | −2032 45 | −2419 96 | 1138 359 | −706 117 | −1883 −369 | −3328 −294 | −3077 −249 | 75 |
| 71(V) | −1760 −149 −16 | −1333 −500 −7108 | −4244 233 −8150 | −3789 43 −894 | −1262 −381 −1115 | −3902 399 −701 | −3190 106 −1378 | 1495 −626 * | −3588 210 * | 1270 −466 | −96 −720 | −3536 275 | −3677 394 | −3238 45 | −3534 96 | −3148 359 | −1725 117 | 2865 −369 | −2654 −294 | −2373 −249 | 76 |
| 72(W) | −1054 −149 −16 | −2172 −500 −7108 | −1112 233 −8150 | −403 43 −894 | −2566 −381 −1115 | −1917 399 −701 | −286 106 −1378 | −2196 −626 * | 2516 210 * | −2095 −466 | −1292 −720 | 1183 275 | −1958 394 | 140 45 | 1333 96 | −959 359 | −922 117 | −1867 −369 | 2591 −294 | −1720 −249 | 77 |
| 73(D) | 611 −149 −16 | −1995 −500 −7108 | 1525 233 −8150 | 937 43 −894 | −2295 −381 −1115 | −1400 399 −701 | −148 106 −1378 | −2043 −626 * | 211 210 * | −2006 −466 | −1106 −720 | −37 275 | −1553 394 | 1420 45 | −312 96 | −408 359 | 1235 117 | −1609 −369 | −2193 −294 | −1499 −249 | 78 |
| 74(A) | 2716 −149 −16 | −902 −500 −7108 | −2380 233 −8150 | −2205 43 −894 | −2799 −381 −1115 | −1197 399 −701 | −1975 106 −1378 | −2459 −626 * | −2081 210 * | −2736 −466 | −1895 −720 | −1520 275 | −1895 394 | −1844 45 | −2201 96 | 1191 359 | 1299 117 | −1669 −369 | −3045 −294 | −2758 −249 | 79 |
| 75(G) | −1709 −149 −16 | −2833 −500 −7108 | 2424 233 −8150 | −409 43 −894 | −3781 −381 −1115 | 2819 399 −701 | 1457 106 −1378 | −3777 −626 * | −1728 210 * | −3733 −466 | −3076 −720 | −739 275 | −2389 394 | −1180 45 | −2441 96 | −1557 359 | −1893 117 | −3158 −369 | −3660 −294 | −3038 −249 | 80 |
| 76(A) | −212 −149 −16 | −1119 −500 −7108 | −2614 233 −8150 | −273 43 −894 | −2534 −381 −1115 | −1983 399 −701 | −1829 106 −1378 | −377 −626 * | −2042 210 * | 1435 −466 | −341 −720 | −1937 275 | −2411 394 | −1873 45 | −2088 96 | −1266 359 | −1059 117 | −397 −369 | −2063 −294 | −1713 −249 | 82 |
| 77(W) | 2529 −149 −16 | −2909 −500 −7108 | −2421 233 −8150 | −2330 43 −894 | −1245 −381 −1115 | −1979 399 −701 | −826 106 −1378 | 1164 −626 * | −1486 210 * | −143 −466 | 2485 −720 | 873 275 | −2028 394 | −1185 45 | −1426 96 | −1048 359 | −412 117 | 1116 −369 | 2999 −294 | −454 −249 | 83 |
| | −472 −149 −16 | −361 −500 −7108 | −1812 233 −8150 | −298 −381 −1115 | | | | | | | | | | | | | | | | |

TABLE 9-continued

| | | | | | | | | | | | | | | | | | |
|---|---|---|---|---|---|---|---|---|---|---|---|---|---|---|---|---|---|
| 78(P) | −1198 −149 −16 | −1737 −500 −7108 | −2187 233 −8150 | −2394 43 −894 | −3665 −381 −1115 | 2006 399 −701 | −2550 106 −1378 | −3630 −626 * | −2743 210 * | −3756 −466 | −3008 −720 | −2052 275 | 3474 394 | −2495 45 | −2835 96 | −1401 359 | −1593 117 | −2736 −369 | −3511 −294 | −3519 −249 | 84 |
| 79(Q) | −999 −149 −16 | −1075 −500 −7108 | −2106 233 −8150 | −1568 43 −894 | −726 −381 −1115 | −2370 399 −701 | −1175 106 −1378 | 83 −626 * | −1185 210 * | 1373 −466 | 218 −720 | −1566 275 | −2400 394 | 2445 45 | −1340 96 | −1445 359 | −946 117 | 1441 −369 | −1501 −294 | −1146 −249 | 85 |
| 80(Q) | −885 −149 −16 | −779 −500 −7108 | −2609 233 −8150 | −2018 43 −894 | −481 −381 −1115 | −2414 399 −701 | −1253 106 −1378 | 1645 −626 * | −1736 210 * | 799 −466 | 1924 −720 | −1827 275 | −2405 394 | 2262 45 | −1752 96 | −1484 359 | −821 117 | 802 −369 | −1240 −294 | −935 −249 | 86 |
| 81(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 87 |
| 82(G) | −998 −149 −16 | −2100 −500 −7108 | −120 233 −8150 | −175 43 −894 | −2567 −381 −1115 | 2528 399 −701 | 2174 106 −1378 | −2558 −626 * | −587 210 * | −2583 −466 | −1806 −720 | 1422 275 | −1966 394 | −461 45 | −1038 96 | −925 359 | −1088 117 | −2095 −369 | −2657 −294 | −1948 −249 | 88 |
| 83(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 89 |
| 84(I) | −1286 −149 −16 | −1279 −500 −7108 | −2907 233 −8150 | −2683 43 −894 | −1446 −381 −1115 | −2549 399 −701 | −2198 106 −1378 | 3290 −626 * | −2407 210 * | −726 −466 | −534 −720 | −2386 275 | 1172 394 | −2299 45 | −2437 96 | −1895 359 | −1392 117 | 283 −369 | −2302 −294 | −1913 −249 | 90 |
| 85(T) | −493 −149 −16 | −1105 −500 −7108 | −2189 233 −8150 | −2267 43 −894 | −3101 −381 −1115 | 1880 399 −701 | −2196 106 −1378 | −2791 −626 * | −2334 210 * | −3081 −466 | −2269 −720 | −1649 275 | −2058 394 | −2099 45 | −2410 96 | −719 359 | 3135 117 | −1948 −369 | −3282 −294 | −3046 −249 | 91 |
| 86(V) | −1750 −149 −16 | −1296 −500 −7108 | −4319 233 −8150 | −3957 43 −894 | −1765 −381 −1115 | −4038 399 −701 | −3733 106 −1378 | 2364 −626 * | −3826 210 * | −619 −466 | −543 −720 | −3716 275 | −3869 394 | −3685 45 | −3902 96 | −3354 359 | −1743 117 | 3012 −369 | −3265 −294 | −2817 −249 | 92 |
| 87(S) | 923 −149 −16 | −962 −500 −7108 | −2348 233 −8150 | −2422 43 −894 | −3132 −381 −1115 | −1207 399 −701 | −2248 106 −1378 | −2850 −626 * | −2440 210 * | −3140 −466 | −2285 −720 | −1624 275 | −1954 394 | −2158 45 | −2477 96 | 3171 359 | −758 117 | −1896 −369 | −3362 −294 | −3103 −249 | 93 |
| 88(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 94 |
| 89(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 95 |
| 90(I) | −1880 −149 −16 | −1493 −500 −7108 | −4193 233 −8150 | −3724 43 −894 | −953 −381 −1115 | −3837 399 −701 | −2980 106 −1378 | 3251 −626 * | −3420 210 * | 257 −466 | 2372 −720 | −3485 275 | −3608 394 | −3005 45 | −3310 96 | −3087 359 | −1840 117 | 617 −369 | −2373 −294 | −2155 −249 | 96 |
| 91(S) | 2150 −149 −16 | −939 −500 −7108 | −2407 233 −8150 | −2415 43 −894 | −3075 −381 −1115 | −1197 399 −701 | −2205 106 −1378 | −2781 −626 * | −2384 210 * | −3065 −466 | −2205 −720 | −1613 275 | −1936 394 | −2105 45 | −2436 96 | 2652 359 | −729 117 | −1850 −369 | −3306 −294 | −3049 −249 | 97 |
| 92(M) | −979 −149 −16 | −1455 −500 −7108 | −1242 233 −8150 | −1122 43 −894 | −1434 −381 −1115 | −1860 399 −701 | −1131 106 −1378 | −1171 −626 * | −974 210 * | −1285 −466 | 4091 −720 | 2176 275 | −2226 394 | −1017 45 | −1187 96 | −1166 359 | −1086 117 | −1063 −369 | −1929 −294 | −1345 −249 | 98 |
| 93(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 99 |
| 94(T) | −959 −149 −16 | −1691 −500 −7108 | −1249 233 −8150 | −949 43 −894 | −2563 −381 −1115 | −1747 399 −701 | −929 106 −1378 | −2093 −626 * | 1282 210 * | −2263 −466 | −1554 −720 | −995 275 | −2115 394 | −600 45 | −354 96 | −1037 359 | 3152 117 | −1726 −369 | −2494 −294 | −2098 −249 | 100 |

TABLE 9-continued

| | | | | | | | | | | | | | | | | | |
|---|---|---|---|---|---|---|---|---|---|---|---|---|---|---|---|---|---|
| 95(E) | -572 | -1860 | -208 | 2213 | -2107 | -1461 | -1808 | 199 | -116 | -983 | -127 | 318 | 1199 | -269 | -475 | -517 | -1448 | -2078 | -1441 | 101 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 96(G) | -2594 | -2690 | -3304 | -3623 | -4328 | 3747 | -4761 | -3953 | -4671 | -4212 | -3320 | -3352 | -3748 | -3779 | -2839 | -2981 | -4004 | -3668 | -4222 | 102 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 97(M) | -2406 | -2296 | -3638 | -3594 | -1525 | -3105 | -1047 | -3121 | -596 | 5043 | -3293 | -3425 | -3046 | -2996 | -2911 | -2552 | -1398 | -2513 | -2207 | 103 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 98(R) | -2097 | -2786 | -2688 | -1415 | -3622 | -2625 | -2964 | 2585 | -2627 | -1957 | -3293 | -2577 | -137 | 3015 | -1979 | -1791 | -2732 | -2469 | -2363 | 104 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 99(Y) | -3615 | -2706 | -4169 | -4413 | 2626 | -4044 | -2535 | -3993 | -1939 | -1985 | -1318 | -3930 | -2852 | -3446 | -3296 | -3494 | -2686 | 347 | 4252 | 105 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 100(S) | -897 | -1462 | -2333 | -2543 | -3185 | -1640 | -3294 | -2686 | -3497 | -2780 | -2747 | -2360 | -2483 | -2703 | 3465 | -1316 | -2413 | -3310 | -3025 | 106 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 101(L) | -2871 | -2457 | -4231 | -4103 | -1033 | -3803 | -541 | -3734 | 3130 | -31 | -1973 | -3797 | -3286 | -3484 | -3713 | -2869 | -1136 | -2394 | -2220 | 107 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 102(V) | -1381 | -1065 | -3714 | -3252 | -1453 | -3300 | 1872 | -3023 | -615 | -373 | -3935 | -3287 | -2816 | -3039 | -2506 | 1346 | 2750 | -2489 | -2087 | 108 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 103(S) | -897 | -1462 | -2333 | -2543 | -3185 | -1640 | -3294 | -2686 | -3497 | -2780 | -2949 | -2360 | -2483 | -2703 | 3465 | -1316 | -2413 | -3310 | -3025 | 109 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 104(R) | -2957 | -3022 | -3318 | -2735 | -3796 | -2998 | -3912 | -846 | -3631 | -3157 | -1973 | -3280 | -1724 | 4056 | -3026 | -2913 | -3650 | -3096 | -3185 | 110 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 105(E) | -1719 | -3572 | 2596 | 2779 | -3767 | -1632 | -3700 | -1241 | -3578 | -2920 | -2611 | -2167 | -666 | -2090 | -1380 | -1789 | -3182 | -3742 | -2756 | 111 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 106(V) | -1746 | -1296 | -4308 | -3946 | -1757 | -4020 | 2190 | -3811 | -614 | -539 | -234 | -3858 | -3667 | -3884 | -3336 | -1740 | 3098 | -3250 | -2803 | 112 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 107(I) | -2091 | -1746 | -3971 | -3840 | -1676 | -3532 | 3684 | -3581 | -659 | -693 | -3702 | -3674 | -3445 | -3521 | -3194 | -2146 | 449 | -2877 | -2493 | 113 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 108(A) | 3438 | -1472 | -2846 | -3040 | -3287 | -1726 | -2840 | -3028 | -3257 | -2662 | -3562 | -2447 | -2798 | -2944 | -1216 | -1387 | -2183 | -3405 | -3320 | 114 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 109(D) | -2784 | -3432 | 4016 | -1200 | -4140 | -2466 | -4505 | -2621 | -4365 | -3956 | -2236 | -3014 | -2039 | -3232 | -2593 | -2938 | -4046 | -3710 | -3552 | 115 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 110(S) | -352 | 2942 | -2955 | -2957 | -2876 | -1254 | -2573 | -2692 | -2927 | -2128 | -1551 | -1827 | -2001 | -2405 | -2607 | 3103 | -778 | -1757 | -3171 | -2911 | 116 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |
| 111(I) | -2091 | -1746 | -3971 | -3840 | -1676 | -3532 | 3684 | -3289 | -659 | -693 | -3562 | -3674 | -3445 | -3521 | -3194 | -2146 | 449 | -2877 | -2493 | 117 |
| — | -149 | -500 | 233 | 43 | -381 | 399 | -626 | 210 | -466 | -720 | 275 | 394 | 45 | 96 | 359 | 117 | -369 | -294 | -249 | |
| — | -16 | -7108 | -8150 | -894 | -1115 | -701 | * | | | | | | | | | | | | | |

TABLE 9-continued

| | | | | | | | | | | | | | | | | | | |
|---|---|---|---|---|---|---|---|---|---|---|---|---|---|---|---|---|---|---|
| 112(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 118 |
| 113(T) | 1556 −149 −16 | −936 −500 −7108 | −2493 233 −8150 | −2457 43 −894 | −2805 −381 −1115 | −1256 399 −701 | −2159 106 −1378 | −2210 −626 * | −2319 210 * | −2681 −466 | −1932 −720 | −1656 275 | −1974 394 | −2089 45 | −2352 96 | −598 359 | 3235 117 | −1547 −369 | −3111 −294 | −2847 −249 | 119 |
| 114(C) | 1784 −149 −16 | 2119 −500 −7108 | −2013 233 −8150 | −1532 43 −894 | −1093 −381 −1115 | −1580 399 −701 | −1089 106 −1378 | −436 −626 * | −1322 210 * | −937 −466 | −273 −720 | 1093 275 | −1932 394 | −1127 45 | −1472 96 | −748 359 | −515 117 | 1585 −369 | −1536 −294 | −1163 −249 | 120 |
| 115(M) | 1831 −149 −16 | 2019 −500 −7108 | −2596 233 −8150 | −2038 43 −894 | −605 −381 −1115 | −1979 399 −701 | −1126 106 −1378 | 244 −626 * | −1727 210 * | −359 −466 | 2501 −720 | −1655 275 | −2145 394 | −1435 45 | −1683 96 | −1106 359 | −557 117 | 1087 −369 | −1153 −294 | −804 −249 | 121 |
| 116(Q) | −987 −149 −16 | −2211 −500 −7108 | −43 233 −8150 | −62 43 −894 | −2833 −381 −1115 | 2229 399 −701 | −691 106 −1378 | −2616 −626 * | −407 210 * | −2604 −466 | −1797 −720 | 1197 275 | −1917 394 | 2260 45 | −858 96 | −880 359 | −1045 117 | −2139 −369 | −2772 −294 | −2099 −249 | 122 |
| 117(G) | 2313 −149 −16 | −1042 −500 −7108 | −2391 233 −8150 | −2526 43 −894 | −3250 −381 −1115 | 2601 399 −701 | −2372 106 −1378 | −2972 −626 * | −2637 210 * | −3257 −466 | −2407 −720 | −1721 275 | −2032 394 | −2310 45 | −2646 96 | −662 359 | −859 117 | −2003 −369 | −3434 −294 | −3247 −249 | 123 |
| 118(Q) | −914 −149 −16 | −2350 −500 −7108 | −48 233 −8150 | 1661 43 −894 | −2621 −381 −1115 | −1571 399 −701 | 2504 106 −1378 | −2400 −626 * | 68 210 * | −2331 −466 | −1486 −720 | −201 275 | −1796 394 | 2646 45 | −351 96 | −754 359 | −865 117 | −1984 −369 | −2463 −294 | −1787 −249 | 124 |
| 119(W) | −517 −149 −16 | −1294 −500 −7108 | −733 233 −8150 | −183 43 −894 | −1062 −381 −1115 | −1605 399 −701 | −234 106 −1378 | −1037 −626 * | 19 210 * | −1207 −466 | −456 −720 | 1435 275 | −1690 394 | 33 45 | 756 96 | 411 359 | −454 117 | −819 −369 | 3340 −294 | 1286 −249 | 125 |
| 120(M) | 410 −149 −16 | −469 −500 −7108 | −2417 233 −8150 | −1828 43 −894 | −341 −381 −1115 | −2041 399 −701 | −897 106 −1378 | 195 −626 * | −1513 210 * | −156 −466 | 3130 −720 | −1534 275 | −2102 394 | −1230 45 | −1484 96 | −1117 359 | −507 117 | 954 −369 | −894 −294 | 2253 −249 | 126 |
| 121(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 127 |
| 122(G) | 2142 −149 −16 | −930 −500 −7108 | −2334 233 −8150 | −2298 43 −894 | −3100 −381 −1115 | 2237 399 −701 | −2139 106 −1378 | −2842 −626 * | −2302 210 * | −3074 −466 | −2187 −720 | −1557 275 | −1909 394 | −2010 45 | −2397 96 | 1136 359 | −701 117 | −1871 −369 | −3308 −294 | −3053 −249 | 128 |
| 123(V) | −1514 −149 −16 | −1144 −500 −7108 | −3950 233 −8150 | −3459 43 −894 | 1821 −381 −1115 | −3487 399 −701 | −2577 106 −1378 | 2274 −626 * | −3208 210 * | −209 −466 | −87 −720 | −3112 275 | −3362 394 | −2864 45 | −3118 96 | −2680 359 | −1476 117 | 2426 −369 | −2194 −294 | −1786 −249 | 129 |
| 124(V) | −1743 −149 −16 | −1294 −500 −7108 | −4292 233 −8150 | −3873 43 −894 | −1511 −381 −1115 | −3988 399 −701 | −3433 106 −1378 | 2287 −626 * | −3712 210 * | 598 −466 | −319 −720 | −3626 275 | −3774 394 | −3456 45 | −3716 96 | −3260 359 | −1717 117 | 2790 −369 | −2931 −294 | −2577 −249 | 130 |
| 125(A) | 2911 −149 −16 | −954 −500 −7108 | −2808 233 −8150 | −2665 43 −894 | −2115 −381 −1115 | −1577 399 −701 | −2196 106 −1378 | −575 −626 * | −2445 210 * | −1646 −466 | −1202 −720 | −1906 275 | −2208 394 | −2218 45 | −2451 96 | −901 359 | −876 117 | 1294 −369 | −2727 −294 | −2394 −249 | 131 |
| 126(I) | −1764 −149 −16 | −1323 −500 −7108 | −4298 233 −8150 | −3936 43 −894 | −1668 −381 −1115 | −3994 399 −701 | −3655 106 −1378 | 3337 −626 * | −3783 210 * | −508 −466 | −462 −720 | −3689 275 | −3838 394 | −3608 45 | −3835 96 | −3311 359 | −1759 117 | 1847 −369 | −3164 −294 | −2747 −249 | 132 |
| 127(G) | −1157 −149 −16 | −1705 −500 −7108 | −2169 233 −8150 | −2375 43 −894 | −3654 −381 −1115 | 3021 399 −701 | −2534 106 −1378 | −3611 −626 * | −2730 210 * | −3741 −466 | −2984 −720 | −2024 275 | 2418 394 | −2475 45 | −2826 96 | −1361 359 | −1555 117 | −2705 −369 | −3513 −294 | −3509 −249 | 133 |
| 128(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 134 |

TABLE 9-continued

| | | | | | | | | | | | | | | | | | | | |
|---|---|---|---|---|---|---|---|---|---|---|---|---|---|---|---|---|---|---|---|
| 129(C) | −2476 −149 −16 | 5735 −500 −7108 | −4102 233 −8150 | −4358 43 −894 | −3712 −381 −1115 | −2763 399 −701 | −3545 106 −1378 | −3518 −626 * | −4167 210 * | −3859 −466 | −3569 −720 | −3631 275 | −3363 394 | −4030 45 | −3832 96 | −2793 359 | −2860 117 | −3158 −369 | −3464 −294 | −3718 −249 | 135 |
| 130(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 136 |
| 131(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 137 |
| 132(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | −4205 275 | −2932 394 | −2205 45 | −2608 96 | −2224 359 | −2439 117 | −3392 −369 | −3253 −294 | −2909 −249 | 138 |
| 133(M) | −2406 −149 −16 | −2296 −500 −7108 | −3638 233 −8150 | −3594 43 −894 | −1525 −381 −1115 | −3105 399 −701 | −2824 106 −1378 | −1047 −626 * | −3121 210 * | −596 −466 | 5043 −720 | −3293 275 | −3425 394 | −3046 45 | −2996 96 | −2911 359 | −2552 117 | −1398 −369 | −2513 −294 | −2207 −249 | 139 |
| 134(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | −4225 394 | −3781 45 | −3695 96 | −3182 359 | −3279 117 | −4087 −369 | −3594 −294 | −4064 −249 | 140 |
| 135(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 141 |
| 136(A) | 2180 −149 −16 | −935 −500 −7108 | −2286 233 −8150 | −2196 43 −894 | −3057 −381 −1115 | 1098 399 −701 | −2058 106 −1378 | −2796 −626 * | −2174 210 * | −3021 −466 | −2134 −720 | −1516 275 | −1898 394 | −1906 45 | −2302 96 | 2146 359 | −689 117 | −1849 −369 | −3256 −294 | −2983 −249 | 142 |
| 137(M) | −1799 −149 −16 | −1433 −500 −7108 | −4142 233 −8150 | −3579 43 −894 | −669 −381 −1115 | −3668 399 −701 | −2608 106 −1378 | 1558 −626 * | −3293 210 * | 1235 −466 | 3799 −720 | −3296 275 | −3401 394 | −2717 45 | −3088 96 | −2843 359 | −1726 117 | 1156 −369 | −2002 −294 | −1868 −249 | 143 |
| 138(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 144 |
| 139(A) | 3103 −149 −16 | −1036 −500 −7108 | −2445 233 −8150 | −2572 43 −894 | −3222 −381 −1115 | 1051 399 −701 | −2380 106 −1378 | −2930 −626 * | −2650 210 * | −3226 −466 | −2381 −720 | −1739 275 | −2034 394 | −2327 45 | −2648 96 | −664 359 | −857 117 | −1981 −369 | −3412 −294 | −3228 −249 | 145 |
| 140(M) | −2325 −149 −16 | −1891 −500 −7108 | −4598 233 −8150 | −4012 43 −894 | −498 −381 −1115 | −4222 399 −701 | −3013 106 −1378 | 1242 −626 * | −3722 210 * | 1864 −466 | 3929 −720 | −3855 275 | −3711 394 | −2910 45 | −3414 96 | −3439 359 | −2215 117 | −299 −369 | −2076 −294 | −2098 −249 | 146 |
| 141(A) | 3103 −149 −16 | −1036 −500 −7108 | −2445 233 −8150 | −2572 43 −894 | −3222 −381 −1115 | 1051 399 −701 | −2380 106 −1378 | −2930 −626 * | −2650 210 * | −3226 −466 | −2381 −720 | −1739 275 | −2034 394 | −2327 45 | −2648 96 | −664 359 | −857 117 | −1981 −369 | −2076 −294 | −3228 −249 | 147 |
| 142(R) | −1588 −149 −16 | −2442 −500 −7108 | −1399 233 −8150 | −953 43 −894 | −3069 −381 −1115 | −2171 399 −701 | −708 106 −1378 | −2795 −626 * | 373 210 * | −2625 −466 | −1916 −720 | 1858 275 | −2357 394 | −324 45 | 3294 96 | −1520 359 | −1505 117 | −2453 −369 | −2523 −294 | −2186 −249 | 148 |
| 143(M) | −1448 −149 −16 | −1256 −500 −7108 | −3396 233 −8150 | −2819 43 −894 | −474 −381 −1115 | −3024 399 −701 | −1923 106 −1378 | 175 −626 * | −2473 210 * | 2225 −466 | 2756 −720 | −2574 275 | −2922 394 | −2063 45 | −2375 96 | −2153 359 | 952 117 | −151 −369 | −1599 −294 | −1410 −249 | 149 |
| 144(N) | −1662 −149 −16 | −3306 −500 −7108 | 2055 233 −8150 | 78 43 −894 | −3621 −381 −1115 | −1643 399 −701 | −1040 106 −1378 | −3622 −626 * | −1272 210 * | −3531 −466 | −2870 −720 | 3477 275 | −2182 394 | −724 45 | −2071 96 | −1371 359 | −1757 117 | −3092 −369 | −3633 −294 | −2700 −249 | 150 |
| 145(I) | −1066 −149 −16 | −921 −500 −7108 | −2828 233 −8150 | −2239 43 −894 | −1041 −381 −1115 | −2675 399 −701 | −1601 106 −1378 | 2235 −626 * | −1668 210 * | −455 −466 | −92 −720 | −2067 275 | −2692 394 | −1688 45 | 1701 96 | −1795 359 | −1024 117 | 1960 −369 | −1771 −294 | −1396 −249 | 151 |

TABLE 9-continued

| | | | | | | | | | | | | | | | | | |
|---|---|---|---|---|---|---|---|---|---|---|---|---|---|---|---|---|---|
| 146(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 152 |
| 147(S) | 1568 −149 −16 | −940 −500 −7108 | −2267 233 −8150 | −2192 43 −894 | −3082 −381 −1115 | 1101 399 −701 | −2068 106 −1378 | −2826 −626 * | −2185 210 * | −3049 −466 | −2159 −720 | −1515 275 | −1901 394 | −1915 45 | −2313 96 | 2603 359 | −694 117 | −1866 −369 | −3279 −294 | −3006 −249 | 153 |
| 148(I) | −1880 −149 −16 | −1492 −500 −7108 | −4195 233 −8150 | −3728 43 −894 | −963 −381 −1115 | −3841 399 −701 | −2991 106 −1378 | 3272 −626 * | −3425 210 * | 246 −466 | 2277 −720 | −3490 275 | −3613 394 | −3014 45 | −3317 96 | −3092 359 | −1841 117 | 628 −369 | −2385 −294 | −2163 −249 | 154 |
| 149(F) | −2204 −149 −16 | −1797 −500 −7108 | −3724 233 −8150 | −3473 43 −894 | 3206 −381 −1115 | −3383 399 −701 | −628 106 −1378 | −1077 −626 * | −3092 210 * | −746 −466 | 3167 −720 | −2502 275 | −3309 394 | −2372 45 | −2792 96 | −2535 359 | −2120 117 | −1245 −369 | 28 −294 | 2460 −249 | 155 |
| 150(V) | 1265 −149 −16 | −1028 −500 −7108 | −3200 233 −8150 | −2994 43 −894 | −1833 −381 −1115 | −2150 399 −701 | −2480 106 −1378 | 417 −626 * | −2771 210 * | −1122 −466 | −818 −720 | −2349 275 | −2640 394 | −2559 45 | −2766 96 | −1464 359 | −1118 117 | 3028 −369 | −2700 −294 | −2325 −249 | 156 |
| 151(Y) | −3482 −149 −16 | −2868 −500 −7108 | −3701 233 −8150 | −3919 43 −894 | 238 −381 −1115 | −3552 399 −701 | −1112 106 −1378 | −3000 −626 * | −3638 210 * | −2516 −466 | −2526 −720 | −3027 275 | −3772 394 | −3101 45 | −3341 96 | −3418 359 | −3527 117 | −3071 −369 | −441 −294 | 4711 −249 | 157 |
| 152(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 158 |
| 153(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 159 |
| 154(T) | −359 −149 −16 | −976 −500 −7108 | −2225 233 −8150 | −2229 43 −894 | −2900 −381 −1115 | −1242 399 −701 | −2074 106 −1378 | −2560 −626 * | −2170 210 * | −2875 −466 | −2064 −720 | −1561 275 | −1958 394 | −1969 45 | −2247 96 | 1110 359 | 3375 117 | −1760 −369 | −3152 −294 | −2850 −249 | 160 |
| 155(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 161 |
| 156(H) | 861 −149 −16 | −1924 −500 −7108 | −384 233 −8150 | 1010 43 −894 | −2260 −381 −1115 | −1477 399 −701 | 1787 106 −1378 | −1974 −626 * | 1769 210 * | −1918 −466 | −1022 −720 | −120 275 | −1566 394 | 362 45 | 697 96 | −417 359 | −459 117 | −1557 −369 | −2073 −294 | −1446 −249 | 162 |
| 157(P) | −655 −149 −16 | −1502 −500 −7108 | −711 233 −8150 | −557 43 −894 | −2204 −381 −1115 | −1463 399 −701 | 2143 106 −1378 | −2122 −626 * | −586 210 * | −2233 −466 | −1445 −720 | −688 275 | 2941 394 | −560 45 | −941 96 | 855 359 | −805 117 | −1657 −369 | −2369 −294 | −1763 −249 | 163 |
| 158(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 164 |
| 159(H) | −744 −149 −16 | −2193 −500 −7108 | −114 233 −8150 | 1118 43 −894 | −2513 −381 −1115 | −1512 399 −701 | 2486 106 −1378 | −2252 −626 * | 1178 210 * | −2183 −466 | −1308 −720 | 2230 275 | −1689 394 | 180 45 | −233 96 | −598 359 | −687 117 | −1823 −369 | −2335 −294 | −1670 −249 | 165 |
| 160(W) | −2672 −149 −16 | −2139 −500 −7108 | −3850 233 −8150 | −3748 43 −894 | 941 −381 −1115 | −3611 399 −701 | −469 106 −1378 | −1691 −626 * | −3306 210 * | 1047 −466 | −1217 −720 | −2551 275 | −3534 394 | −2514 45 | −2960 96 | −2788 359 | −2577 117 | −1799 −369 | 4205 −294 | 3466 −249 | 166 |
| 161(K) | 386 −149 −16 | −1981 −500 −7108 | 779 233 −8150 | 279 43 −894 | −2295 −381 −1115 | −1403 399 −701 | −114 106 −1378 | −2043 −626 * | 2059 210 * | −1991 −466 | −1082 −720 | 941 275 | −1536 394 | 1263 45 | −211 96 | −384 359 | −457 117 | −1602 −369 | −2161 −294 | −1476 −249 | 167 |
| 162(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 168 |

TABLE 9-continued

| | | | | | | | | | | | | | | | | | | | | | |
|---|---|---|---|---|---|---|---|---|---|---|---|---|---|---|---|---|---|---|---|---|---|
| 163(K) | -1144<br>-149<br>-16 | -2365<br>-500<br>-7108 | -912<br>233<br>-8150 | 2048<br>43<br>-894 | -2856<br>-381<br>-1115 | -1912<br>399<br>-701 | -326<br>106<br>-1378 | -2459<br>-626<br>* | 2267<br>210<br>* | -2295<br>-466 | -1482<br>-720 | -556<br>275 | -1989<br>394 | 108<br>45 | 1334<br>96 | -1013<br>359 | -1014<br>117 | -2093<br>-369 | -2324<br>-294 | -1881<br>-249 | 169 |
| 164(D) | -1091<br>-149<br>-16 | -2610<br>-500<br>-7108 | 2941<br>233<br>-8150 | 174<br>43<br>-894 | -2957<br>-381<br>-1115 | -1527<br>399<br>-701 | -595<br>106<br>-1378 | -2750<br>-626<br>* | 1084<br>210<br>* | -2696<br>-466 | -1877<br>-720 | -176<br>275 | -1885<br>394 | -206<br>45 | -1006<br>96 | 740<br>359 | -1098<br>117 | -2288<br>-369 | -2880<br>-294 | -2105<br>-249 | 170 |
| 165(L) | -2387<br>-149<br>-16 | -1922<br>-500<br>-7108 | -4674<br>233<br>-8150 | -4155<br>43<br>-894 | -617<br>-381<br>-1115 | -4366<br>399<br>-701 | -3250<br>106<br>-1378 | 1889<br>-626<br>* | -3865<br>210<br>* | 2650<br>-466 | 558<br>-720 | -4023<br>275 | -3847<br>394 | -3098<br>45 | -3586<br>96 | -3647<br>359 | -2296<br>117 | -38<br>-369 | -2247<br>-294 | -2224<br>-249 | 171 |
| 166(N) | -1021<br>-149<br>-16 | -2427<br>-500<br>-7108 | 1806<br>233<br>-8150 | 133<br>43<br>-894 | -2870<br>-381<br>-1115 | -1499<br>399<br>-701 | -635<br>106<br>-1378 | -2647<br>-626<br>* | -521<br>210<br>* | -2640<br>-466 | -1825<br>-720 | 2171<br>275 | -1874<br>394 | -255<br>45 | -1124<br>96 | -860<br>359 | 2122<br>117 | -2184<br>-369 | -2853<br>-294 | -2090<br>-249 | 172 |
| 167(I) | -1830<br>-149<br>-16 | -1390<br>-500<br>-7108 | -4327<br>233<br>-8150 | -3873<br>43<br>-894 | -1210<br>-381<br>-1115 | -3994<br>399<br>-701 | -3274<br>106<br>-1378 | 2967<br>-626<br>* | -3678<br>210<br>* | 1259<br>-466 | -30<br>-720 | -3633<br>275 | -3730<br>394 | -3283<br>45 | -3604<br>96 | -3249<br>359 | -1791<br>117 | 1570<br>-369 | -2661<br>-294 | -2417<br>-249 | 173 |
| 168(V) | -1771<br>-149<br>-16 | -1603<br>-500<br>-7108 | -3750<br>233<br>-8150 | -3689<br>43<br>-894 | -2037<br>-381<br>-1115 | -3050<br>399<br>-701 | -3231<br>106<br>-1378 | 403<br>-626<br>* | -3479<br>210<br>* | -1154<br>-466 | -1076<br>-720 | -3246<br>275 | -3399<br>394 | -3383<br>45 | -3437<br>96 | -2628<br>359 | -1917<br>117 | 3536<br>-369 | -3074<br>-294 | -2677<br>-249 | 174 |
| 169(S) | -897<br>-149<br>-16 | -1462<br>-500<br>-7108 | -2333<br>233<br>-8150 | -2543<br>43<br>-894 | -3185<br>-381<br>-1115 | -1640<br>399<br>-701 | -2474<br>106<br>-1378 | -3294<br>-626<br>* | -2686<br>210<br>* | -3497<br>-466 | -2780<br>-720 | -1973<br>275 | -2360<br>394 | -2483<br>45 | -2703<br>96 | 3465<br>359 | -1316<br>117 | -2413<br>-369 | -3310<br>-294 | -3025<br>-249 | 175 |
| 170(A) | 2440<br>-149<br>-16 | -824<br>-500<br>-7108 | -2371<br>233<br>-8150 | -2082<br>43<br>-894 | -1993<br>-381<br>-1115 | -1344<br>399<br>-701 | -1704<br>106<br>-1378 | -1264<br>-626<br>* | -1899<br>210<br>* | -1832<br>-466 | -1137<br>-720 | -1517<br>275 | -1946<br>394 | -1674<br>45 | -2005<br>96 | 1075<br>359 | -641<br>117 | 1474<br>-369 | -2390<br>-294 | -2055<br>-249 | 176 |
| 171(F) | -3342<br>-149<br>-16 | -2776<br>-500<br>-7108 | -4026<br>233<br>-8150 | -4232<br>43<br>-894 | 4354<br>-381<br>-1115 | -3545<br>399<br>-701 | -1431<br>106<br>-1378 | -2315<br>-626<br>* | -4038<br>210<br>* | -4671<br>-466 | -1900<br>-720 | -3299<br>275 | -3780<br>394 | -3350<br>45 | -3645<br>96 | -3490<br>359 | -3420<br>117 | -2566<br>-369 | -739<br>-294 | 349<br>-249 | 177 |
| 172(E) | -2641<br>-149<br>-16 | -3308<br>-500<br>-7108 | -896<br>233<br>-8150 | 3732<br>43<br>-894 | -3966<br>-381<br>-1115 | -2458<br>399<br>-701 | -2043<br>106<br>-1378 | -4105<br>-626<br>* | -2128<br>210<br>* | -4016<br>-466 | -3555<br>-720 | -1531<br>275 | -2959<br>394 | -1842<br>45 | -2560<br>96 | -2479<br>359 | -2750<br>117 | -3722<br>-369 | -3563<br>-294 | -3385<br>-249 | 178 |
| 173(A) | 2966<br>-149<br>-16 | -1031<br>-500<br>-7108 | -2429<br>233<br>-8150 | -2551<br>43<br>-894 | -3222<br>-381<br>-1115 | 1544<br>399<br>-701 | -2368<br>106<br>-1378 | -2934<br>-626<br>* | -2633<br>210<br>* | -3225<br>-466 | -2377<br>-720 | -1727<br>275 | -2028<br>394 | -2309<br>45 | -2637<br>96 | -656<br>359 | -850<br>117 | -1980<br>-369 | -3412<br>-294 | -3224<br>-249 | 179 |
| 174(V) | -1769<br>-149<br>-16 | -1342<br>-500<br>-7108 | -4255<br>233<br>-8150 | -3793<br>43<br>-894 | -1216<br>-381<br>-1115 | -3901<br>399<br>-701 | -3162<br>106<br>-1378 | 1633<br>-626<br>* | -3589<br>210<br>* | 1486<br>-466 | -51<br>-720 | -3537<br>275 | -3667<br>394 | -3214<br>45 | -3518<br>96 | -3143<br>359 | -1731<br>117 | 2692<br>-369 | -2609<br>-294 | -2345<br>-249 | 180 |
| 175(G) | -2594<br>-149<br>-16 | -2690<br>-500<br>-7108 | -3304<br>233<br>-8150 | -3623<br>43<br>-894 | -4328<br>-381<br>-1115 | 3747<br>399<br>-701 | -3462<br>106<br>-1378 | -4761<br>-626<br>* | -3953<br>210<br>* | -4671<br>-466 | -4212<br>-720 | -3320<br>275 | -3352<br>394 | -3748<br>45 | -3779<br>96 | -2839<br>359 | -2981<br>117 | -4004<br>-369 | -3668<br>-294 | -4222<br>-249 | 181 |
| 176(Q) | -729<br>-149<br>-16 | -2116<br>-500<br>-7108 | -413<br>233<br>-8150 | 1096<br>43<br>-894 | -2484<br>-381<br>-1115 | -1587<br>399<br>-701 | 1599<br>106<br>-1378 | -2186<br>-626<br>* | 1695<br>210<br>* | -2094<br>-466 | -1219<br>-720 | -223<br>275 | -1698<br>394 | 2418<br>45 | 90<br>96 | -599<br>359 | -649<br>117 | -1770<br>-369 | -2213<br>-294 | -1615<br>-249 | 182 |
| 177(W) | -1652<br>-149<br>-16 | -1707<br>-500<br>-7108 | -2340<br>233<br>-8150 | -1879<br>43<br>-894 | 1996<br>-381<br>-1115 | -2733<br>399<br>-701 | 2013<br>106<br>-1378 | -1398<br>-626<br>* | 1758<br>210<br>* | -1386<br>-466 | -938<br>-720 | -1641<br>275 | -2751<br>394 | -1364<br>45 | -1762<br>96 | -1780<br>359 | -1577<br>117 | -1325<br>-369 | 3577<br>-294 | 2136<br>-249 | 183 |
| 178(T) | -421<br>-149<br>-16 | -753<br>-500<br>-7108 | -1251<br>233<br>-8150 | -704<br>43<br>-894 | -846<br>-381<br>-1115 | -1670<br>399<br>-701 | -535<br>106<br>-1378 | 894<br>-626<br>* | -548<br>210<br>* | -690<br>-466 | -1<br>-720 | 1376<br>275 | -1791<br>394 | -421<br>45 | -846<br>96 | 373<br>359 | 1461<br>117 | 858<br>-369 | -1236<br>-294 | -812<br>-249 | 184 |
| 179(H) | 1498<br>-149<br>-16 | -1593<br>-500<br>-7108 | -504<br>233<br>-8150 | 15<br>43<br>-894 | -1895<br>-381<br>-1115 | -1484<br>399<br>-701 | 2279<br>106<br>-1378 | -1559<br>-626<br>* | 1119<br>210<br>* | -1640<br>-466 | -810<br>-720 | -242<br>275 | -1611<br>394 | 194<br>45 | -171<br>96 | -462<br>359 | 815<br>117 | -1231<br>-369 | -1914<br>-294 | -1340<br>-249 | 185 |

TABLE 9-continued

| | | | | | | | | | | | | | | | | |
|---|---|---|---|---|---|---|---|---|---|---|---|---|---|---|---|---|
| 180(G) | −1515<br>−149<br>−16 | −2130<br>−500<br>−7108 | −1298<br>233<br>−8150 | −1450<br>−894 | −2658<br>−381<br>−1115 | 3285<br>399<br>−701 | 2212<br>106<br>−1378 | −3276<br>−626<br>* | −1691<br>210<br>* | −3291<br>−466 | −2638<br>−720 | −1524<br>275 | −2562<br>394 | −1662<br>45 | −1925<br>96 | −1600<br>359 | −1764<br>117 | −2713<br>−369 | −2804<br>−294 | −2234<br>−249 | 186 |
| 181(K) | −528<br>−149<br>−16 | −2010<br>−500<br>−7108 | 1346<br>233<br>−8150 | 1082<br>43<br>−894 | −2329<br>−381<br>−1115 | −1408<br>399<br>−701 | −118<br>106<br>−1378 | −2080<br>−626<br>* | 1475<br>210<br>* | −2018<br>−466 | −1108<br>−720 | 1161<br>275 | −1543<br>394 | 331<br>45 | 1052<br>96 | −394<br>359 | −471<br>117 | −1632<br>−369 | −2181<br>−294 | −1494<br>−249 | 187 |
| 182(M) | −1894<br>−149<br>−16 | −1521<br>−500<br>−7108 | −4170<br>233<br>−8150 | −3679<br>43<br>−894 | −840<br>−381<br>−1115 | −3793<br>399<br>−701 | −2866<br>106<br>−1378 | 2827<br>−626<br>* | −3360<br>210<br>* | 375<br>−466 | 3445<br>−720 | −3437<br>275 | −3555<br>394 | −2902<br>45 | −3223<br>96 | −3028<br>359 | −1846<br>117 | 470<br>−369 | −2249<br>−294 | −2059<br>−249 | 188 |
| 183(T) | −670<br>−149<br>−16 | −1758<br>−500<br>−7108 | 1731<br>233<br>−8150 | −141<br>43<br>−894 | −2591<br>−381<br>−1115 | −1399<br>399<br>−701 | −691<br>106<br>−1378 | −2319<br>−626<br>* | −499<br>210<br>* | −2384<br>−466 | −1543<br>−720 | −387<br>275 | −1786<br>394 | −316<br>45 | −1016<br>96 | 1576<br>359 | 2044<br>117 | −1811<br>−369 | −2624<>−294 | −1981<br>−249 | 189 |
| 184(E) | 345<br>−149<br>−16 | −2074<br>−500<br>−7108 | 925<br>233<br>−8150 | 1994<br>43<br>−894 | −2378<br>−381<br>−1115 | −1408<br>399<br>−701 | −177<br>106<br>−1378 | −2135<br>−626<br>* | 922<br>210<br>* | −2084<br>−466 | −1183<br>−720 | −38<br>275 | 641<br>394 | 264<br>45 | −356<br>96 | −444<br>359 | −536<br>117 | −1690<br>−369 | −2261<br>−294 | −1556<br>−249 | 190 |
| 185(E) | −1493<br>−149<br>−16 | −2900<br>−500<br>−7108 | 93<br>233<br>−8150 | 3174<br>43<br>−894 | −2903<br>−381<br>−1115 | −1743<br>399<br>−701 | 1987<br>106<br>−1378 | −3042<br>−626<br>* | −646<br>210<br>* | −2957<br>−466 | −2238<br>−720 | −411<br>275 | −2146<br>394 | −506<br>45 | −1121<br>96 | −1272<br>359 | −1503<br>117 | −2629<br>−369 | −2905<br>−294 | −2134<br>−249 | 191 |
| 186(D) | −1293<br>−149<br>−16 | −2959<br>−500<br>−7108 | 2673<br>233<br>−8150 | 2121<br>43<br>−894 | −3219<br>−381<br>−1115 | −1546<br>399<br>−701 | −713<br>106<br>−1378 | −3043<br>−626<br>* | −707<br>210<br>* | −2974<br>−466 | −2191<br>−720 | −158<br>275 | −1967<br>394 | −342<br>45 | −1394<br>96 | −1043<br>359 | 701<br>117 | −2567<br>−369 | −3172<br>−294 | −2311<br>−249 | 192 |
| 187(F) | −1137<br>−149<br>−16 | −905<br>−500<br>−7108 | −3250<br>233<br>−8150 | −2707<br>43<br>−894 | 2365<br>−381<br>−1115 | −2647<br>399<br>−701 | −1016<br>106<br>−1378 | −34<br>−626<br>* | −2336<br>210<br>* | 1239<br>−466 | 267<br>−720 | −2150<br>275 | −2626<br>394 | −1861<br>45 | −2133<br>96 | −1752<br>359 | −1069<br>117 | 1461<br>−369 | −599<br>−294 | 1844<br>−249 | 193 |
| 188(K) | −479<br>−149<br>−16 | −1713<br>−500<br>−7108 | −409<br>233<br>−8150 | 1031<br>43<br>−894 | −1925<br>−381<br>−1115 | −1467<br>399<br>−701 | 1755<br>106<br>−1378 | −1650<br>−626<br>* | 1844<br>210<br>* | −349<br>−466 | −827<br>−720 | −140<br>275 | −1556<br>394 | 319<br>45 | −75<br>96 | −403<br>359 | −411<br>117 | −1301<br>−369 | −1900<br>−294 | 843<br>−249 | 194 |
| 189(G) | 433<br>−149<br>−16 | 3528<br>−500<br>−7108 | 52<br>233<br>−8150 | 1047<br>43<br>−894 | −2717<br>−381<br>−1115 | 2303<br>399<br>−701 | −615<br>106<br>−1378 | −2467<br>−626<br>* | −442<br>210<br>* | −2482<br>−466 | −1655<br>−720 | 1123<br>275 | −1828<br>394 | −233<br>45 | −995<br>96 | −763<br>359 | −923<br>117 | −2000<br>−369 | −2710<br>−294 | −2005<br>−249 | 195 |
| 190(V) | −1478<br>−149<br>−16 | −2144<br>−500<br>−7108 | −261<br>233<br>−8150 | −403<br>43<br>−894 | −2011<br>−381<br>−1115 | −1837<br>399<br>−701 | 2032<br>106<br>−1378 | 1701<br>−626<br>* | −3614<br>210<br>* | 1188<br>−466 | −140<br>−720 | −3551<br>275 | −2259<br>394 | −721<br>45 | −1085<br>96 | −1352<br>359 | −1546<br>117 | −2522<br>−369 | −2307<br>−294 | −1431<br>−249 | 196 |
| 191(E) | −1752<br>−149<br>−16 | −1320<br>−500<br>−7108 | −4254<br>233<br>−8150 | −3806<br>43<br>−894 | −1311<br>−381<br>−1115 | −3916<br>399<br>−701 | −3232<br>106<br>−1378 | 1892<br>−626<br>* | −867<br>210<br>* | −1273<br>−466 | −897<br>−720 | −922<br>275 | −2295<br>394 | −797<br>45 | −1238<br>96 | −3166<br>359 | −1718<br>117 | 2833<br>−369 | −2703<br>−294 | −2409<br>−249 | 197 |
| 192(C) | −1199<br>−149<br>−16 | −1750<br>−500<br>−7108 | −734<br>233<br>−8150 | 2668<br>43<br>−894 | −1820<br>−381<br>−1115 | −2038<br>399<br>−701 | −1068<br>106<br>−1378 | −2840<br>−626<br>* | −3028<br>210<br>* | −1273<br>−466 | −897<br>−720 | −922<br>275 | −2295<br>394 | −1340<br>45 | −1238<br>96 | −1340<br>359 | −1197<br>117 | −426<br>−369 | −2325<br>−294 | −1789<br>−249 | 198 |
| 193(N) | −1182<br>−149<br>−16 | 3528<br>−500<br>−7108 | −1398<br>233<br>−8150 | −620<br>43<br>−894 | −2541<br>−381<br>−1115 | −2038<br>399<br>−701 | −358<br>106<br>−1378 | −2093<br>−626<br>* | 1181<br>210<br>* | −2037<br>−466 | −1272<br>−720 | −747<br>275 | −2070<br>394 | 1553<br>45 | 2213<br>96 | −1123<br>359 | −1038<br>117 | −1817<br>−369 | −2142<br>−294 | −1774<br>−249 | 199 |
| 194(A) | −1478<br>−149<br>−16 | −2527<br>−500<br>−7108 | −261<br>233<br>−8150 | −403<br>43<br>−894 | −2011<br>−381<br>−1115 | −1837<br>399<br>−701 | 2032<br>106<br>−1378 | −2925<br>−626<br>* | −735<br>210<br>* | −2845<br>−466 | −2195<br>−720 | 3635<br>275 | −2259<br>394 | −721<br>45 | −1085<br>96 | −1352<br>359 | −1546<br>117 | −2522<br>−369 | −2307<br>−294 | −1431<br>−249 | 199 |
| 194(A) | 3438<br>−149<br>−16 | −1472<br>−500<br>−7108 | −2846<br>233<br>−8150 | −3040<br>43<br>−894 | −3287<br>−381<br>−1115 | −1726<br>399<br>−701 | −2735<br>106<br>−1378 | −2840<br>−626<br>* | −3028<br>210<br>* | −3257<br>−466 | −2662<br>−720 | −2236<br>275 | −2447<br>394 | −2798<br>45 | −2944<br>96 | −1216<br>359 | −1387<br>117 | −2183<br>−369 | −3405<br>−294 | −3320<br>−249 | 200 |
| 195(C) | −1220<br>−149<br>−16 | 4911<br>−500<br>−7108 | −3609<br>233<br>−8150 | −3314<br>43<br>−894 | −1440<br>−381<br>−1115 | −2525<br>399<br>−701 | −2482<br>106<br>−1378 | 1565<br>−626<br>* | −2922<br>210<br>* | −706<br>−466 | −544<br>−720 | −2678<br>275 | −2896<br>394 | −2710<br>45 | −2836<br>96 | −1869<br>359 | −1375<br>117 | 379<br>−369 | −2371<br>−294 | −1957<br>−249 | 201 |
| 196(P) | −2931<br>−149<br>−16 | −2878<br>−500<br>−7108 | −3420<br>233<br>−8150 | −3706<br>43<br>−894 | −4181<br>−381<br>−1115 | −2925<br>399<br>−701 | −3468<br>106<br>−1378 | −4621<br>−626<br>* | −3859<br>210<br>* | −4490<br>−466 | −4165<br>−720 | −3491<br>275 | 4225<br>394 | −3781<br>45 | −3695<br>96 | −3182<br>359 | −3279<br>117 | −4087<br>−369 | −3594<br>−294 | −4064<br>−249 | 202 |

TABLE 9-continued

| | | | | | | | | | | | | | | | | | | |
|---|---|---|---|---|---|---|---|---|---|---|---|---|---|---|---|---|---|---|
| 197(G) | −477 −149 −16 | −1115 −500 −7108 | −1983 233 −8150 | −2189 43 −894 | −3315 −381 −1115 | 3154 399 −701 | −2272 106 −1378 | −3172 −626 * | −2506 210 * | −3387 −466 | −2522 −720 | −1599 275 | −2042 394 | −2177 45 | −2583 96 | 1217 359 | −905 117 | −2130 −369 | −3477 −294 | −3225 −249 | 203 |
| 198(A) | 1653 −149 −16 | −1347 −500 −7108 | −705 233 −8150 | −249 43 −894 | −1969 −381 −1115 | −1385 399 −701 | −477 106 −1378 | −1629 −626 * | −159 210 * | −1759 −466 | −935 −720 | −434 275 | 1285 394 | 1404 45 | −586 96 | −450 359 | 1019 117 | −1243 −369 | −2070 −294 | −1522 −249 | 204 |
| 199(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 205 |
| 200(S) | 1870 −149 −16 | −938 −500 −7108 | −2270 233 −8150 | −2183 43 −894 | −3068 −381 −1115 | 1488 399 −701 | −2056 106 −1378 | −2810 −626 * | −2168 210 * | −3032 −466 | −2144 −720 | −1511 275 | −1898 394 | −1901 45 | −2300 96 | 2236 359 | −690 117 | −1857 −369 | −3265 −294 | −2990 −249 | 206 |
| 201(C) | −2476 −149 −16 | 5735 −500 −7108 | −4102 233 −8150 | −4358 43 −894 | −3712 −381 −1115 | −2763 399 −701 | −3545 106 −1378 | −3518 −626 * | −4167 210 * | −3859 −466 | −3569 −720 | −3631 275 | −3363 394 | −4030 45 | −3832 96 | −2793 359 | −2860 117 | −3158 −369 | −3464 −294 | −3718 −249 | 207 |
| 202(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 208 |
| 203(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 209 |
| 204(M) | −2406 −149 −16 | −2296 −500 −7108 | −3638 233 −8150 | −3594 43 −894 | −1525 −381 −1115 | −3105 399 −701 | −2824 106 −1378 | −1047 −626 * | −3121 210 * | −596 −466 | 5043 −720 | −3293 275 | −3425 394 | −3046 45 | −2996 96 | −2911 359 | −2552 117 | −1398 −369 | −2513 −294 | −2207 −249 | 210 |
| 205(Y) | −3590 −149 −16 | −2700 −500 −7108 | −4146 233 −8150 | −4379 43 −894 | 2092 −381 −1115 | −4028 399 −701 | −404 106 −1378 | −2517 −626 * | −3963 210 * | −1928 −466 | −1973 −720 | −2744 275 | −3921 394 | −2845 45 | −3431 96 | −3284 359 | −3474 117 | −2669 −369 | 336 −294 | 4423 −249 | 211 |
| 206(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 212 |
| 207(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 213 |
| 208(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 214 |
| 209(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 215 |
| 210(M) | −2355 −149 −16 | −1988 −500 −7108 | −4343 233 −8150 | −3834 43 −894 | −504 −381 −1115 | −4051 399 −701 | −2868 106 −1378 | 105 −626 * | −3385 210 * | 1451 −466 | 4460 −720 | −3680 275 | −3671 394 | −2806 45 | −3171 96 | −3327 359 | −2274 117 | −474 −369 | −2039 −294 | −1925 −249 | 216 |
| 211(S) | 2150 −149 −16 | −939 −500 −7108 | −2407 233 −8150 | −2415 43 −894 | −3075 −381 −1115 | −1197 399 −701 | −2205 106 −1378 | −2781 −626 * | −2384 210 * | −3065 −466 | −2205 −720 | −1613 275 | −1936 394 | −2105 45 | −2436 96 | 2652 359 | −729 117 | −1850 −369 | −3306 −294 | −3049 −249 | 217 |
| 212(S) | −344 −149 −16 | −979 −500 −7108 | −2190 233 −8150 | −2162 43 −894 | −2959 −381 −1115 | −1227 399 −701 | −2042 106 −1378 | −2651 −626 * | −2116 210 * | −2934 −466 | −2100 −720 | −1526 275 | −1941 394 | −1909 45 | −2222 96 | 2940 359 | 1775 117 | −1804 −369 | −3187 −294 | −2882 −249 | 218 |
| 213(A) | 3048 −149 −16 | −932 −500 −7108 | −2480 233 −8150 | −2533 43 −894 | −3075 −381 −1115 | −1200 399 −701 | −2274 106 −1378 | −2765 −626 * | −2501 210 * | −3071 −466 | −2221 −720 | −1658 275 | −1948 394 | −2205 45 | −2512 96 | 1225 359 | −739 117 | −1842 −369 | −3322 −294 | −3078 −249 | 219 |

TABLE 9-continued

| | | | | | | | | | | | | | | | |
|---|---|---|---|---|---|---|---|---|---|---|---|---|---|---|---|
| 214(I) | −1924 −149 −16 | −1546 −500 −7108 | −4067 233 −8150 | −3658 43 −894 | 2312 −381 −1115 | −3663 399 −701 | −2081 106 −1378 | 3030 −626 * | −3367 210 * | 150 −466 | 99 −720 | −3197 275 | −3492 394 | −2821 45 | −3179 96 | −2894 359 |
| 215(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 |
| 216(A) | 2389 −149 −16 | −814 −500 −7108 | −2506 233 −8150 | −2162 43 −894 | −1696 −381 −1115 | −1545 399 −701 | −1698 106 −1378 | −499 −626 * | −1942 210 * | −1398 −466 | −813 −720 | −1640 275 | −2076 394 | −1723 45 | −2027 96 | −806 359 |
| 217(M) | −2576 −149 −16 | −2118 −500 −7108 | −4725 233 −8150 | −4165 43 −894 | −461 −381 −1115 | −4430 399 −701 | −3165 106 −1378 | 99 −626 * | −3811 210 * | 2513 −466 | 3454 −720 | −4075 275 | −3839 394 | −2978 45 | −3488 96 | −3704 359 |
| 218(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 |
| 219(M) | −2313 −149 −16 | −1968 −500 −7108 | −4258 233 −8150 | −3765 43 −894 | −518 −381 −1115 | −3966 399 −701 | −2806 106 −1378 | 98 −626 * | −3289 210 * | 1292 −466 | 4523 −720 | −3599 275 | −3636 394 | −2769 45 | −3097 96 | −3249 359 |
| 220(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 |
| 221(L) | −2631 −149 −16 | −2159 −500 −7108 | −4786 233 −8150 | −4228 43 −894 | −462 −381 −1115 | −4506 399 −701 | −3231 106 −1378 | 96 −626 * | −3878 210 * | 2828 −466 | 2482 −720 | −4157 275 | −3880 394 | −3016 45 | −3541 96 | −3793 359 |
| 222(P) | −1501 −149 −16 | −1778 −500 −7108 | −2473 233 −8150 | −2371 43 −894 | −1710 −381 −1115 | −2311 399 −701 | −2045 106 −1378 | −1321 −626 * | −2060 210 * | 827 −466 | −1068 −720 | −2173 275 | 3594 394 | −2082 45 | −2130 96 | −1799 359 |
| 223(Y) | −1068 −149 −16 | −1670 −500 −7108 | −865 233 −8150 | −836 43 −894 | −631 −381 −1115 | 1198 399 −701 | −767 106 −1378 | −1828 −626 * | −1059 210 * | −1914 −466 | −1304 −720 | 692 275 | −2203 394 | −906 45 | −1387 96 | −1136 359 |
| 224(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 |
| 225(S) | 1172 −149 −16 | −954 −500 −7108 | −2367 233 −8150 | −2422 43 −894 | −3120 −381 −1115 | −1204 399 −701 | −2237 106 −1378 | −2835 −626 * | −2426 210 * | −3122 −466 | −2265 −720 | −1621 275 | −1948 394 | −2145 45 | −2467 96 | 3107 359 |
| 226(S) | −342 −149 −16 | −975 −500 −7108 | −2176 233 −8150 | −2124 43 −894 | −2912 −381 −1115 | −1229 399 −701 | −2003 106 −1378 | −2594 −626 * | −2067 210 * | −2878 −466 | −2048 −720 | −1510 275 | −1936 394 | −1866 45 | −2184 96 | 2553 359 |
| 227(M) | −720 −149 −16 | −1440 −500 −7108 | −710 233 −8150 | −343 43 −894 | −1228 −381 −1115 | −1693 399 −701 | 2436 106 −1378 | −1209 −626 * | −132 210 * | −1364 −466 | 3099 −720 | 1904 275 | −1852 394 | −183 45 | −458 96 | −776 359 |
| 228(P) | 2240 −149 −16 | −1100 −500 −7108 | −2241 233 −8150 | −2293 43 −894 | −3037 −381 −1115 | −1346 399 −701 | −2188 106 −1378 | −2683 −626 * | −2317 210 * | −2986 −466 | −2210 −720 | −1663 275 | 3041 394 | −2093 45 | −2391 96 | −722 359 |
| 229(A) | 2958 −149 −16 | −1235 −500 −7108 | −1299 233 −8150 | −1377 43 −894 | −2868 −381 −1115 | −1345 399 −701 | −1673 106 −1378 | −2580 −626 * | −1661 210 * | −2843 −466 | −2054 −720 | 1555 275 | −1995 394 | −1468 45 | −1921 96 | −715 359 |
| 230(E) | −509 −149 −16 | −1046 −500 −7108 | −884 233 −8150 | 1564 43 −894 | −1116 −381 −1115 | −1669 399 −701 | −441 106 −1378 | −485 −626 * | −283 210 * | 250 −466 | −206 −720 | −577 275 | 689 394 | −200 45 | −656 96 | −670 359 |

| | | | | | |
|---|---|---|---|---|---|
| −1877 117 | 293 −369 | −1445 −294 | −692 −249 | 220 |
| −2750 117 | −3722 −369 | −3563 −294 | −3385 −249 | 221 |
| 1148 117 | 1559 −369 | −2200 −294 | −1856 −249 | 222 |
| −2457 117 | −591 −369 | −2111 −294 | −2145 −249 | 223 |
| −2981 117 | −4004 −369 | −3668 −294 | −4222 −249 | 224 |
| −2243 117 | −457 −369 | −2026 −294 | −1874 −249 | 225 |
| −1316 117 | −2413 −369 | −3310 −294 | −3025 −249 | 226 |
| −2509 117 | −608 −369 | −2134 −294 | −2182 −249 | 227 |
| −1699 117 | −1373 −369 | −2373 −294 | −1942 −249 | 228 |
| −1163 117 | −1566 −369 | −1185 −294 | 3670 −249 | 229 |
| −1316 117 | −2413 −369 | −3310 −294 | −3025 −249 | 230 |
| −749 117 | −1884 −369 | −3349 −294 | −3092 −249 | 231 |
| 2492 117 | −1773 −369 | −3143 −294 | −2833 −249 | 232 |
| −680 117 | −1004 −369 | −1540 −294 | −890 −249 | 233 |
| −895 117 | −1893 −369 | −3243 −294 | −2998 −249 | 234 |
| −888 117 | −1871 −369 | −3064 −294 | −2630 −249 | 235 |
| −459 117 | 1290 −369 | −1467 −294 | −995 −249 | 236 |

| | | | | | | | | | | | | | | | | | | | |
|---|---|---|---|---|---|---|---|---|---|---|---|---|---|---|---|---|---|---|---|
| 231(D) | −1203 −149 −16 | −2412 −500 −7108 | 2595 233 −8150 | −117 43 −894 | −3286 −381 −1115 | −1536 399 −701 | −1057 106 −1378 | −3176 −626 * | −1165 210 * | −3186 −466 | −2436 −720 | −428 275 | −2068 394 | −736 45 | −1824 96 | 2377 359 | −1366 117 | −2578 −369 | −3334 −294 | −2552 −249 | 237 |
| 232(Q) | 954 −149 −16 | −1983 −500 −7108 | −100 233 −8150 | 971 43 −894 | −2337 −381 −1115 | 177 399 −701 | −267 106 −1378 | −2067 −626 * | 81 210 * | −2060 −466 | −1189 −720 | −125 275 | −1637 394 | 2600 45 | −418 96 | −514 359 | −597 117 | −1649 −369 | −2268 −294 | −1597 −249 | 238 |
| 233(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 239 |
| 234(K) | −2620 −149 −16 | −2961 −500 −7108 | −2046 233 −8150 | 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 240 |
| 235(R) | 377 −149 −16 | −1802 −500 −7108 | −415 233 −8150 | 988 43 −894 | −2095 −381 −1115 | −1474 399 −701 | −95 106 −1378 | −1786 −626 * | 1452 210 * | −1785 −466 | −911 −720 | −135 275 | −1560 394 | 343 45 | 1555 96 | −409 359 | −431 117 | 376 −369 | −1986 −294 | −1375 −249 | 241 |
| 236(D) | 1083 −149 −16 | −1565 −500 −7108 | 2662 233 −8150 | −244 43 −894 | −1941 −381 −1115 | −1573 399 −701 | −679 106 −1378 | 612 −626 * | −527 210 * | −1651 −466 | −980 −720 | −490 275 | −1869 394 | −358 45 | −1003 96 | −771 359 | −766 117 | −903 −369 | −2208 −294 | −1633 −249 | 242 |
| 237(E) | −1225 −149 −16 | −2868 −500 −7108 | 1894 233 −8150 | 1948 43 −894 | −3149 −381 −1115 | −1532 399 −701 | −671 106 −1378 | −2975 −626 * | −630 210 * | −2902 −466 | −2101 −720 | −150 275 | −1935 394 | −293 45 | −1299 96 | 1884 359 | −1241 117 | −2496 −369 | −3093 −294 | −2248 −249 | 243 |
| 238(C) | 1375 −149 −16 | 3262 −500 −7108 | −2620 233 −8150 | −2108 43 −894 | −827 −381 −1115 | −1866 399 −701 | −1267 106 −1378 | 1631 −626 * | −1811 210 * | −599 −466 | −10 −720 | −1674 275 | −2137 394 | −1531 45 | −1786 96 | −1034 359 | 790 117 | 249 −369 | −1361 −294 | −1010 −249 | 244 |
| 239(E) | 635 −149 −16 | −1796 −500 −7108 | 1055 233 −8150 | 1761 43 −894 | −2018 −381 −1115 | −1464 399 −701 | −263 106 −1378 | 1191 −626 * | 28 210 * | −1767 −466 | −946 −720 | −148 275 | −1637 394 | 135 45 | −481 96 | −520 359 | −553 117 | −1300 −369 | −2077 −294 | −1441 −249 | 245 |
| 240(E) | 593 −149 −16 | −2044 −500 −7108 | −252 233 −8150 | 2548 43 −894 | −2437 −381 −1115 | −1542 399 −701 | −329 106 −1378 | −2133 −626 * | 151 210 * | −2120 −466 | −1274 −720 | −244 275 | −1738 394 | 89 45 | 946 96 | −646 359 | −717 117 | −1734 −369 | −2305 −294 | −1686 −249 | 246 |
| 241(S) | 1884 −149 −16 | −835 −500 −7108 | −1962 233 −8150 | −1576 43 −894 | −1634 −381 −1115 | −1436 399 −701 | −1320 106 −1378 | 1041 −626 * | −1409 210 * | −1453 −466 | −781 −720 | −1293 275 | −1922 394 | −1241 45 | −1606 96 | 1973 359 | −597 117 | −669 −369 | −2036 −294 | −1656 −249 | 247 |
| 242(G) | 2267 −149 −16 | −1043 −500 −7108 | −2388 233 −8150 | −2526 43 −894 | −3253 −381 −1115 | 2642 399 −701 | −2373 106 −1378 | −2975 −626 * | −2639 210 * | −3260 −466 | −2410 −720 | −1722 275 | −2033 394 | −2311 45 | −2648 96 | −663 359 | −860 117 | −2005 −369 | −3436 −294 | −3250 −249 | 248 |
| 243(R) | −876 −149 −16 | −2087 −500 −7108 | −829 233 −8150 | 1490 43 −894 | −2474 −381 −1115 | −1766 399 −701 | −229 106 −1378 | −2106 −626 * | 1269 210 * | −44 −466 | −1198 −720 | −424 275 | −1829 394 | 205 45 | 2225 96 | −775 359 | −768 117 | −1753 −369 | −2143 −294 | −1647 −249 | 249 |
| 244(V) | 2339 −149 −16 | −967 −500 −7108 | −2970 233 −8150 | −2766 43 −894 | −1878 −381 −1115 | −1847 399 −701 | −2252 106 −1378 | 32 −626 * | −2541 210 * | −1299 −466 | −918 −720 | −2087 275 | −2399 394 | −2316 45 | −2545 96 | −1157 359 | −971 117 | 2345 −369 | −2605 −294 | −2251 −249 | 250 |
| 245(I) | −1827 −149 −16 | −1398 −500 −7108 | −4307 233 −8150 | −3831 43 −894 | −1099 −381 −1115 | −3939 399 −701 | −3142 106 −1378 | 2286 −626 * | −3619 210 * | 1835 −466 | 69 −720 | −3579 275 | −3671 394 | −3177 45 | −3511 96 | −3178 359 | −1781 117 | 1918 −369 | −2524 −294 | −2310 −249 | 251 |
| 246(V) | −1178 −149 −16 | −1448 −500 −7108 | −1943 233 −8150 | −1452 43 −894 | −1776 −381 −1115 | −2261 399 −701 | −1140 106 −1378 | −227 −626 * | 1866 210 * | −1260 −466 | −816 −720 | −1444 275 | −2448 394 | −902 45 | −540 96 | −1496 359 | −1176 117 | 2697 −369 | −2161 −294 | −1764 −249 | 252 |
| 247(E) | −508 −149 −16 | −1976 −500 −7108 | 840 233 −8150 | 1547 43 −894 | −2280 −381 −1115 | −1393 399 −701 | −117 106 −1378 | −2029 −626 * | 1400 210 * | −1984 −466 | −1077 −720 | 1158 275 | −1531 394 | 330 45 | −253 96 | −378 359 | −454 117 | 262 −369 | −2163 −294 | −1471 −249 | 253 |

TABLE 9-continued

| | | | | | | | | | | | | | | | | | | | | |
|---|---|---|---|---|---|---|---|---|---|---|---|---|---|---|---|---|---|---|---|---|
| 248(M) | 1703 -149 -16 | -991 -500 -7108 | -2901 233 -8150 | -2342 43 -894 | -528 -381 -1115 | -2567 399 -701 | -1550 106 -1378 | 166 -626 * | -2031 210 * | 1544 -466 | 2668 -720 | -2104 275 | -2591 394 | -1715 45 | -2010 96 | -1685 359 | -1052 117 | -12 -369 | -1442 -294 | -1177 -249 | 254 |
| 249(I) | -1947 -149 -16 | -1516 -500 -7108 | -4385 233 -8150 | -3885 43 -894 | -916 -381 -1115 | -4013 399 -701 | -3118 106 -1378 | 2193 -626 * | -3656 210 * | 2186 -466 | 257 -720 | -3656 275 | -3687 394 | -3109 45 | -3494 96 | -3250 359 | -1889 117 | 1383 -369 | -2397 -294 | -2258 -249 | 255 |
| 250(E) | -1322 -149 -16 | -2647 -500 -7108 | -272 233 -8150 | 2491 43 -894 | -3071 -381 -1115 | -1811 399 -701 | -576 106 -1378 | -2759 -626 * | 2306 210 * | -2633 -466 | -1854 -720 | -464 275 | -2066 394 | -175 45 | -177 96 | -1144 359 | -1256 117 | -2368 -369 | -2692 -294 | -2140 -249 | 256 |
| 251(K) | -1395 -149 -16 | -2059 -500 -7108 | -1711 233 -8150 | -1014 43 -894 | -2215 -381 -1115 | -2218 399 -701 | -641 106 -1378 | -1709 -626 * | 3021 210 * | -1652 -466 | 2578 -720 | -1075 275 | -2303 394 | -282 45 | 287 96 | -1423 359 | -1283 117 | -1603 -369 | -2159 -294 | -1803 -249 | 257 |
| 252(D) | -1285 -149 -16 | -2888 -500 -7108 | 2667 233 -8150 | 176 43 -894 | -3210 -381 -1115 | 1189 399 -701 | -737 106 -1378 | -3047 -626 * | -715 210 * | -2977 -466 | -2195 -720 | -190 275 | -1979 394 | 2106 45 | -1379 96 | -1050 359 | -1315 117 | -2564 -369 | -3161 -294 | -2320 -249 | 258 |
| 253(I) | -2073 -149 -16 | -1632 -500 -7108 | -4434 233 -8150 | -3975 43 -894 | -911 -381 -1115 | -4130 399 -701 | -3238 106 -1378 | 3164 -626 * | -3706 210 * | 1451 -466 | 244 -720 | -3779 275 | -3785 394 | -3187 45 | -3557 96 | -3413 359 | -2021 117 | 546 -369 | -2449 -294 | -2273 -249 | 259 |
| 254(K) | -1570 -149 -16 | -2144 -500 -7108 | -1887 233 -8150 | -1191 43 -894 | -2098 -381 -1115 | -2363 399 -701 | -750 106 -1378 | -1603 -626 * | 3034 210 * | 938 -466 | -1112 -720 | -1231 275 | -2436 394 | -408 45 | 215 96 | -1616 359 | -1443 117 | -1580 -369 | -2166 -294 | -1804 -249 | 260 |
| 255(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -3785 394 | -3781 45 | -3695 96 | -3182 359 | -3279 117 | -4087 -369 | -3594 -294 | -4064 -249 | 261 |
| 256(R) | -928 -149 -16 | -1705 -500 -7108 | -1507 233 -8150 | -1055 43 -894 | -2761 -381 -1115 | -1730 399 -701 | -896 106 -1378 | -2490 -626 * | -44 210 * | -2489 -466 | -1723 -720 | -1042 275 | -2102 394 | -543 45 | 2614 96 | 2258 359 | -1053 117 | -1998 -369 | -2546 -294 | -2158 -249 | 262 |
| 257(D) | -1280 -149 -16 | -2865 -500 -7108 | 3154 233 -8150 | 175 43 -894 | -3194 -381 -1115 | -1547 399 -701 | -743 106 -1378 | -3034 -626 * | -728 210 * | -2971 -466 | -2194 -720 | -190 275 | -1979 394 | 1342 45 | -1391 96 | 553 359 | -1316 117 | -2552 -369 | -3161 -294 | -2317 -249 | 263 |
| 258(I) | -1997 -149 -16 | -1562 -500 -7108 | -4355 233 -8150 | -3927 43 -894 | -1042 -381 -1115 | -4066 399 -701 | -3261 106 -1378 | 3343 -626 * | -3654 210 * | 937 -466 | 97 -720 | -3718 275 | -3783 394 | -3239 45 | -3555 96 | -3364 359 | -1959 117 | 702 -369 | -2549 -294 | -2295 -249 | 264 |
| 259(M) | -2252 -149 -16 | -1821 -500 -7108 | -4572 233 -8150 | -3991 43 -894 | -530 -381 -1115 | -4164 399 -701 | -2990 106 -1378 | 2068 -626 * | -3709 210 * | 1993 -466 | 3197 -720 | -3808 275 | -3685 394 | -2916 45 | -3406 96 | -3378 359 | -2149 117 | -172 -369 | -2084 -294 | -2091 -249 | 265 |
| 260(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 266 |
| 261(R) | -2131 -149 -16 | -2786 -500 -7108 | -2704 233 -8150 | -1460 43 -894 | -3618 -381 -1115 | -2638 399 -701 | -587 106 -1378 | -2976 -626 * | 1735 210 * | -2645 -466 | -1985 -720 | -1353 275 | -2603 394 | -173 45 | 3492 96 | -2020 359 | -1828 117 | -2748 -369 | -2484 -294 | -2384 -249 | 267 |
| 262(K) | -1349 -149 -16 | -2635 -500 -7108 | -381 233 -8150 | 2083 43 -894 | -3083 -381 -1115 | -1857 399 -701 | -565 106 -1378 | -2750 -626 * | 2690 210 * | -2612 -466 | -1837 -720 | -514 275 | -2090 394 | -161 45 | -61 96 | -1178 359 | -1271 117 | -2369 -369 | -2655 -294 | -2138 -249 | 268 |
| 263(A) | 2821 -149 -16 | -932 -500 -7108 | -2451 233 -8150 | -2472 43 -894 | -3065 -381 -1115 | -1198 399 -701 | -2233 106 -1378 | -2763 -626 * | -2434 210 * | -3056 -466 | -2201 -720 | -1633 275 | -1940 394 | -2147 45 | -2468 96 | 1831 359 | -730 117 | -1840 -369 | -3305 -294 | -3055 -249 | 269 |
| 264(F) | -2063 -149 -16 | -1686 -500 -7108 | -4037 233 -8150 | -3677 43 -894 | 3437 -381 -1115 | -3644 399 -701 | -1706 106 -1378 | 2063 -626 * | -3359 210 * | 135 -466 | 67 -720 | -3095 275 | -3486 394 | -2739 45 | -3127 96 | -2876 359 | -2012 117 | -83 -369 | -1038 -294 | -158 -249 | 270 |

TABLE 9-continued

| | | | | | | | | | | | | | | | | |
|---|---|---|---|---|---|---|---|---|---|---|---|---|---|---|---|---|
| 265(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 271 |
| 266(N) | −1662 −149 −16 | −3306 −500 −7108 | 2055 233 −8150 | 78 43 −894 | −3621 −381 −1115 | −1643 399 −701 | −1040 106 −1378 | −3622 −626 * | −1272 210 * | −3531 −466 | −2870 −720 | 3477 275 | −2182 394 | −724 45 | −2071 96 | −1371 359 | −1757 117 | −3092 −369 | −3633 −294 | −2700 −249 | 272 |
| 267(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 273 |
| 268(I) | −1760 −149 −16 | −1307 −500 −7108 | −4325 233 −8150 | −3962 43 −894 | −1735 −381 −1115 | −4042 399 −701 | −3726 106 −1378 | 3135 −626 * | −3828 210 * | −579 −466 | −515 −720 | −3722 275 | −3869 394 | −3673 45 | −3896 96 | −3359 359 | −1752 117 | 2276 −369 | −3240 −294 | −2806 −249 | 274 |
| 269(T) | 1428 −149 −16 | −904 −500 −7108 | −2334 233 −8150 | −2158 43 −894 | −2747 −381 −1115 | −1206 399 −701 | −1940 106 −1378 | −2392 −626 * | −2037 210 * | −2678 −466 | −1846 −720 | −1504 275 | −1896 394 | −1809 45 | −2163 96 | 902 359 | 3001 117 | −1635 −369 | −2999 −294 | −2705 −249 | 275 |
| 270(V) | −1745 −149 −16 | −1300 −500 −7108 | −4286 233 −8150 | −3858 43 −894 | −1446 −381 −1115 | −3967 399 −701 | −3370 106 −1378 | 2358 −626 * | −3688 210 * | 852 −466 | −261 −720 | −3606 275 | −3749 394 | −3403 45 | −3673 96 | −3232 359 | −1717 117 | 2643 −369 | −2856 −294 | −2524 −249 | 276 |
| 271(V) | −1404 −149 −16 | −1072 −500 −7108 | −3766 233 −8150 | −3305 43 −894 | −1464 −381 −1115 | −3356 399 −701 | −2696 106 −1378 | 2276 −626 * | −3080 210 * | −616 −466 | −379 −720 | −3001 275 | −3325 394 | −2870 45 | −3091 96 | −2563 359 | 1344 117 | 2521 −369 | −2516 −294 | −2113 −249 | 277 |
| 272(M) | 866 −149 −16 | −1113 −500 −7108 | −2656 233 −8150 | −2412 43 −894 | −1322 −381 −1115 | −1920 399 −701 | −1883 106 −1378 | −487 −626 * | −2061 210 * | −587 −466 | 4451 −720 | −1950 275 | −2387 394 | −1928 45 | −2078 96 | −1220 359 | −1053 117 | −498 −369 | −2134 −294 | −1803 −249 | 278 |
| 273(A) | 2601 −149 −16 | −957 −500 −7108 | −2898 233 −8150 | −2711 43 −894 | −1943 −381 −1115 | −1740 399 −701 | −2211 106 −1378 | −165 −626 * | −2487 210 * | −1406 −466 | −1001 −720 | −2008 275 | −2320 394 | −2260 45 | −2494 96 | −1053 359 | −929 117 | 1990 −369 | −2626 −294 | −2279 −249 | 279 |
| 274(L) | −1171 −149 −16 | −983 −500 −7108 | −3266 233 −8150 | −2733 43 −894 | −796 −381 −1115 | −2795 399 −701 | −1888 106 −1378 | 590 −626 * | −2418 210 * | 2001 −466 | 198 −720 | −2418 275 | −2816 394 | −2106 45 | −2362 96 | −1944 359 | 965 117 | 1777 −369 | −1724 −294 | −1426 −249 | 280 |
| 275(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 281 |
| 276(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 282 |
| 277(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 283 |
| 278(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 284 |
| 279(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 285 |
| 280(A) | 3134 −149 −16 | −934 −500 −7108 | −2491 233 −8150 | −2567 43 −894 | −3083 −381 −1115 | −1203 399 −701 | −2300 106 −1378 | −2766 −626 * | −2540 210 * | −3082 −466 | −2237 −720 | −1672 275 | −1954 394 | −2240 45 | −2537 96 | 874 359 | −747 117 | −1844 −369 | −3333 −294 | −3093 −249 | 286 |
| 281(V) | −984 −149 −16 | −1045 −500 −7108 | −3169 233 −8150 | −2909 43 −894 | −1709 −381 −1115 | −2304 399 −701 | −2404 106 −1378 | 531 −626 * | −2643 210 * | −988 −466 | −697 −720 | −2378 275 | −2722 394 | −2480 45 | −2661 96 | −1601 359 | 1504 117 | 3014 −369 | −2588 −294 | −2201 −249 | 287 |

TABLE 9-continued

| | | | | | | | | | | | | | | | | | | |
|---|---|---|---|---|---|---|---|---|---|---|---|---|---|---|---|---|---|---|
| 282(L) | -2631 -149 -16 | -2159 -500 -7108 | -4786 233 -8150 | -4228 43 -894 | -462 -381 -1115 | -4506 399 -701 | -3231 106 -1378 | 96 -626 * | -3878 210 * | 2828 -466 | 2482 -720 | -4157 275 | -3880 394 | -3016 45 | -3541 96 | -3793 359 | -2509 117 | -608 -369 | -2134 -294 | -2182 -249 | 288 |
| 283(H) | -3205 -149 -16 | -3079 -500 -7108 | -2723 233 -8150 | -2890 43 -894 | -2110 -381 -1115 | -3046 399 -701 | 5295 106 -1378 | -4135 -626 * | -2617 210 * | -3813 -466 | -3561 -720 | -2886 275 | -3482 394 | -2833 45 | -2620 96 | -3291 359 | -3356 117 | -3895 -369 | -2397 -294 | -1681 -249 | 289 |
| 284(L) | -1623 -149 -16 | -1338 -500 -7108 | -3726 233 -8150 | -3164 43 -894 | -251 -381 -1115 | -3255 399 -701 | -1820 106 -1378 | 1373 -626 * | -2808 210 * | 2371 -466 | 514 -720 | -2785 275 | -3086 394 | -2281 45 | -2613 96 | -2389 359 | -1543 117 | -161 -369 | -1311 -294 | 1782 -249 | 290 |
| 285(L) | -2333 -149 -16 | -1873 -500 -7108 | -4640 233 -8150 | -4127 43 -894 | -650 -381 -1115 | -4326 399 -701 | -3241 106 -1378 | 2176 -626 * | -3843 210 * | 2519 -466 | 523 -720 | -3982 275 | -3833 394 | -3105 45 | -3579 96 | -3604 359 | -2247 117 | 56 -369 | -2268 -294 | -2230 -249 | 291 |
| 286(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 292 |
| 287(M) | -1886 -149 -16 | -1507 -500 -7108 | -4178 233 -8150 | -3693 43 -894 | -877 -381 -1115 | -3806 399 -701 | -2901 106 -1378 | 3008 -626 * | -3380 210 * | 335 -466 | 3109 -720 | -3451 275 | -3570 394 | -2934 45 | -3251 96 | -3044 359 | -1840 117 | 524 -369 | -2288 -294 | -2089 -249 | 293 |
| 288(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 294 |
| 289(H) | -1490 -149 -16 | -2484 -500 -7108 | -362 233 -8150 | -476 43 -894 | -1816 -381 -1115 | -1880 399 -701 | 4320 106 -1378 | -2854 -626 * | -684 210 * | -2770 -466 | -2133 -720 | 2185 275 | -2285 394 | -728 45 | -1000 96 | -1377 359 | -1550 117 | -2475 -369 | -2146 -294 | -1255 -249 | 295 |
| 290(A) | 2439 -149 -16 | -911 -500 -7108 | -2326 233 -8150 | -2131 43 -894 | -2811 -381 -1115 | -1197 399 -701 | -1934 106 -1378 | -2480 -626 * | -2011 210 * | -2745 -466 | -1898 -720 | -1490 275 | -1888 394 | -1785 45 | -2153 96 | 1898 359 | 1073 117 | -1682 -369 | -3044 -294 | -2749 -249 | 296 |
| 291(I) | 2038 -149 -16 | -985 -500 -7108 | -3388 233 -8150 | -2919 43 -894 | -1320 -381 -1115 | -2893 399 -701 | -2277 106 -1378 | 2155 -626 * | -2677 210 * | -587 -466 | -297 -720 | -2593 275 | -2992 394 | -2450 45 | -2697 96 | -2087 359 | -1208 117 | 1681 -369 | -2229 -294 | -1846 -249 | 297 |
| 292(G) | -1243 -149 -16 | -2769 -500 -7108 | 311 233 -8150 | 1902 43 -894 | -3172 -381 -1115 | 1980 399 -701 | -744 106 -1378 | -2992 -626 * | -697 210 * | -2936 -466 | -2152 -720 | 1923 275 | -1974 394 | -377 45 | -1331 96 | -1030 359 | -1284 117 | -2506 -369 | -3125 -294 | -2308 -249 | 298 |
| 293(V) | -1738 -149 -16 | -1298 -500 -7108 | -4281 233 -8150 | -3921 43 -894 | -1737 -381 -1115 | -3979 399 -701 | -3665 106 -1378 | 1917 -626 * | -3774 210 * | -601 -466 | -528 -720 | -3671 275 | -3834 394 | -3628 45 | -3843 96 | -3293 359 | -1735 117 | 3205 -369 | -3215 -294 | -2770 -249 | 299 |
| 294(E) | -833 -149 -16 | -2344 -500 -7108 | 1092 233 -8150 | 2412 43 -894 | -2643 -381 -1115 | -1464 399 -701 | -386 106 -1378 | -2413 -626 * | -146 210 * | -2369 -466 | -1505 -720 | -96 275 | 562 394 | 29 45 | -717 96 | -666 359 | 862 117 | -1966 -369 | -2562 -294 | -1818 -249 | 300 |
| 295(W) | -1380 -149 -16 | -1116 -500 -7108 | -3614 233 -8150 | -3026 43 -894 | 1322 -381 -1115 | -2981 399 -701 | -1582 106 -1378 | 1966 -626 * | -2661 210 * | 1775 -466 | 556 -720 | -2562 275 | -2865 394 | -2117 45 | -2424 96 | -2098 359 | -1302 117 | -187 -369 | 2908 -294 | -629 -249 | 301 |
| 296(T) | -350 -149 -16 | -973 -500 -7108 | -2204 233 -8150 | -2178 43 -894 | -2893 -381 -1115 | -1236 399 -701 | -2035 106 -1378 | -2561 -626 * | -2117 210 * | -2862 -466 | -2043 -720 | -1536 275 | -1946 394 | -1916 45 | -2214 96 | 1618 359 | 3198 117 | -1758 -369 | -3137 -294 | -2831 -249 | 302 |
| 297(L) | -1443 -149 -16 | -1269 -500 -7108 | -3144 233 -8150 | -2576 43 -894 | -528 -381 -1115 | -3014 399 -701 | -1816 106 -1378 | 1945 -626 * | -2155 210 * | 2102 -466 | 508 -720 | -2422 275 | -2899 394 | 1193 45 | -2133 96 | -2129 359 | -1369 117 | -50 -369 | -1616 -294 | -1384 -249 | 303 |
| 298(D) | -1826 -149 -16 | -3682 -500 -7108 | 3559 233 -8150 | 1199 43 -894 | -3883 -381 -1115 | -1662 399 -701 | -1073 106 -1378 | -3846 -626 * | -1391 210 * | -3720 -466 | -3110 -720 | -272 275 | -2222 394 | -760 45 | -2283 96 | -1471 359 | -1913 117 | -3321 -369 | -3864 -294 | -2864 -249 | 304 |

TABLE 9-continued

| | | | | | | | | | | | | | | | | | | | | |
|---|---|---|---|---|---|---|---|---|---|---|---|---|---|---|---|---|---|---|---|---|
| 299(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 305 |
| 300(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 306 |
| 301(Q) | −1048 −149 −16 | −2608 −500 −7108 | 205 233 −8150 | 2170 43 −894 | −2893 −381 −1115 | −1535 399 −701 | −505 106 −1378 | −2680 −626 * | −255 210 * | −2604 −466 | −1769 −720 | 1814 275 | −1849 394 | 2272 45 | −789 96 | −848 359 | −1028 117 | −2228 −369 | −2770 −294 | −2013 −249 | 307 |
| 302(R) | 1083 −149 −16 | −1687 −500 −7108 | 691 233 −8150 | 135 43 −894 | −2058 −381 −1115 | −1406 399 −701 | −178 106 −1378 | −1755 −626 * | 214 210 * | −1793 −466 | −924 −720 | −145 275 | −1553 394 | 247 45 | 1670 96 | −383 359 | 1217 117 | −1367 −369 | −2031 −294 | −1404 −249 | 308 |
| 303(I) | −1915 −149 −16 | −1536 −500 −7108 | −4077 233 −8150 | −3667 43 −894 | 2027 −381 −1115 | −3678 399 −701 | −2155 106 −1378 | 3137 −626 * | −3381 210 * | 144 −466 | 94 −720 | −3225 275 | −3506 394 | −2848 45 | −3202 96 | −2914 359 | −1871 117 | 345 −369 | −1522 −294 | −791 −249 | 309 |
| 304(R) | −689 −149 −16 | −2015 −500 −7108 | −494 233 −8150 | 24 43 −894 | −2395 −381 −1115 | −1582 399 −701 | −184 106 −1378 | −2087 −626 * | 444 210 * | −2020 −466 | −1151 −720 | 1161 275 | −1687 394 | 1832 45 | 2131 96 | 626 359 | −614 117 | −1684 −369 | −2156 −294 | −1573 −249 | 310 |
| 305(D) | 387 −149 −16 | −1967 −500 −7108 | 1600 233 −8150 | 1359 43 −894 | −2275 −381 −1115 | −1391 399 −701 | 1561 106 −1378 | −2025 −626 * | 282 210 * | −1976 −466 | −1067 −720 | −25 275 | −1525 394 | 342 45 | 1024 96 | −369 359 | −443 117 | −1584 −369 | −2152 −294 | −1462 −249 | 311 |
| 306(R) | −1460 −149 −16 | −2315 −500 −7108 | −1793 233 −8150 | −887 43 −894 | −2832 −381 −1115 | −2237 399 −701 | −431 106 −1378 | −2288 −626 * | 2193 210 * | −2199 −466 | −1473 −720 | −946 275 | −2245 394 | −20 45 | 2706 96 | −1394 359 | −1275 117 | 591 −369 | −2248 −294 | −1961 −249 | 312 |
| 307(V) | −941 −149 −16 | −1027 −500 −7108 | −3099 233 −8150 | −2832 43 −894 | −1692 −381 −1115 | −2234 399 −701 | −2324 106 −1378 | 470 −626 * | −2565 210 * | −1003 −466 | −695 −720 | −2305 275 | −2663 394 | −2399 45 | −2587 96 | −1527 359 | 1858 117 | 2876 −369 | −2536 −294 | −2152 −249 | 313 |
| 308(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 314 |
| 309(V) | −1090 −149 −16 | −1215 −500 −7108 | −2097 233 −8150 | −1824 43 −894 | −819 −381 −1115 | −2221 399 −701 | 2699 106 −1378 | −287 −626 * | −1392 210 * | −1027 −466 | −591 −720 | −1674 275 | −2482 394 | −1446 45 | −1482 96 | −1482 359 | −1143 117 | 2879 −369 | −1420 −294 | −707 −249 | 315 |
| 310(L) | −2439 −149 −16 | −1972 −500 −7108 | −4702 233 −8150 | −4181 43 −894 | −588 −381 −1115 | −4401 399 −701 | −3258 106 −1378 | 1582 −626 * | −3881 210 * | 2757 −466 | 587 −720 | −4061 275 | −3862 394 | −3093 45 | −3590 96 | −3689 359 | −2344 117 | −130 −369 | −2230 −294 | −2217 −249 | 316 |
| 311(C) | 2157 −149 −16 | 4166 −500 −7108 | −3012 233 −8150 | −2973 43 −894 | −2780 −381 −1115 | 1022 399 −701 | −2337 106 −1378 | −2398 −626 * | −2724 210 * | −2744 −466 | −1930 −720 | −1786 275 | −1943 394 | −2372 45 | −2623 96 | −540 359 | −692 117 | −1624 −369 | −3091 −294 | −2881 −249 | 317 |
| 312(D) | −1732 −149 −16 | −3453 −500 −7108 | 3468 233 −8150 | 99 43 −894 | −3733 −381 −1115 | −1645 399 −701 | −1066 106 −1378 | −3747 −626 * | −1356 210 * | −3641 −466 | −3008 −720 | 1690 275 | −2201 394 | −755 45 | −2209 96 | −1416 359 | −1833 117 | −3208 −369 | −3752 −294 | −2776 −249 | 318 |
| 313(L) | −2477 −149 −16 | −2023 −500 −7108 | −4713 233 −8150 | −4122 43 −894 | 1592 −381 −1115 | −4329 399 −701 | −2920 106 −1378 | 72 −626 * | −3835 210 * | 2593 −466 | 2472 −720 | −3948 275 | −3754 394 | −2914 45 | −3466 96 | −3550 359 | −2350 117 | −634 −369 | −1927 −294 | −1830 −249 | 319 |
| 314(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 320 |
| 315(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 321 |

TABLE 9-continued

| | | | | | | | | | | | | | | | | | | | |
|---|---|---|---|---|---|---|---|---|---|---|---|---|---|---|---|---|---|---|---|
| 316(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 322 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 317(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 323 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 318(K) | 2 | −2257 | −1073 | −374 | −2740 | −1908 | −278 | −2339 | 2328 | −2192 | −1373 | −562 | −1953 | 2273 | 1344 | −952 | −933 | −1980 | −2234 | −1799 | 324 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 319(Y) | −3482 | −2868 | −3701 | −3919 | 238 | −3552 | −1112 | −3000 | −3638 | −2516 | −2526 | −3027 | −3772 | −3101 | −3341 | −3418 | −3527 | −3071 | −441 | 4711 | 325 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 320(M) | −1559 | −1267 | −3829 | −3380 | −1103 | −3357 | −2655 | 805 | −3067 | −64 | 3046 | −3065 | −3326 | −2779 | −3011 | −2591 | −1556 | 2855 | −2312 | −1998 | 326 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 321(M) | 1225 | −469 | −2256 | −1679 | 1656 | −1926 | −870 | 90 | −1396 | −210 | 2763 | −1424 | −2028 | −1129 | −1411 | −1008 | 712 | 154 | −951 | −586 | 327 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 322(T) | −738 | −2094 | −84 | 1704 | −2416 | −1495 | −317 | −2135 | 61 | −2127 | −1275 | −163 | −1704 | 1857 | −405 | −613 | 1930 | −1734 | −2331 | −1668 | 328 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 323(D) | −1746 | −3458 | 3540 | 90 | −3744 | −1650 | −1081 | −3767 | −1381 | −3662 | −3036 | 1386 | −2211 | −772 | −2239 | −1429 | −1850 | −3226 | −3765 | −2789 | 329 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 324(L) | −2451 | −1983 | −4707 | −4186 | −582 | −4409 | −3259 | 1510 | −3884 | 2778 | 592 | −4069 | −3865 | −3091 | −3590 | −3698 | −2355 | −150 | −2226 | −2214 | 330 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 325(H) | −2923 | −2573 | −2959 | −2926 | 826 | −3449 | 4553 | −2508 | −2463 | −2054 | −1948 | −2279 | −3499 | −2191 | −2397 | −2761 | −2855 | −2540 | 123 | 2920 | 331 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 326(K) | 373 | −1957 | −342 | 1025 | −2297 | −1472 | −98 | −2018 | 2111 | −1954 | −1056 | 906 | −1570 | 352 | 685 | −424 | −473 | −1592 | −2105 | −1469 | 332 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 327(V) | 1739 | −1008 | −3509 | −3043 | −1376 | −3028 | −2406 | 1765 | −2807 | −615 | −334 | −2718 | −3093 | −2585 | −2823 | −2226 | −1263 | 2376 | −2322 | −1931 | 333 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 328(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 334 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 329(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 335 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 330(I) | −1758 | −1302 | −4331 | −3970 | −1756 | −4054 | −3748 | 2976 | −3840 | −603 | −533 | −3731 | −3877 | −3693 | −3914 | −3372 | −1750 | 2505 | −3265 | −2824 | 336 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 331(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 337 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 332(Q) | 1795 | −1440 | −730 | −492 | −2453 | 682 | −812 | −2151 | −508 | −2256 | −1426 | −624 | −1796 | 2666 | −901 | −590 | −689 | −1636 | −2510 | −1971 | 338 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |

TABLE 9-continued

| | | | | | | | | | | | | | | | | | | | |
|---|---|---|---|---|---|---|---|---|---|---|---|---|---|---|---|---|---|---|---|
| 333(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 339 |
| 334(M) | −2355 −149 −16 | −1988 −500 −7108 | −4343 233 −8150 | −3834 43 −894 | −504 −381 −1115 | −4051 399 −701 | −2868 106 −1378 | 105 −626 * | −3385 210 * | 1451 −466 | 4460 −720 | −3680 275 | −3671 394 | −2806 45 | −3171 96 | −3327 359 | −2274 117 | −474 −369 | −2039 −294 | −1925 −249 | 340 |
| 335(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 341 |
| 336(Y) | −1187 −149 −16 | −974 −500 −7108 | −3186 233 −8150 | −2638 43 −894 | −117 −381 −1115 | −2732 399 −701 | −1255 106 −1378 | 1905 −626 * | −2270 210 * | 73 −466 | 1977 −720 | −2217 275 | −2699 394 | −1882 45 | −2144 96 | −1841 359 | −1124 117 | 71 −369 | −907 −294 | 3254 −249 | 342 |
| 337(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 343 |
| 338(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 344 |
| 339(K) | −864 −149 −16 | −1785 −500 −7108 | −860 233 −8150 | −366 43 −894 | −2128 −381 −1115 | −1763 399 −701 | −407 106 −1378 | −1612 −626 * | 2624 210 * | −1800 −466 | −1045 −720 | 629 275 | −1900 394 | −28 45 | 62 96 | −851 359 | −805 117 | 1127 −369 | −2064 −294 | −1581 −249 | 345 |
| 340(N) | 602 −149 −16 | −1686 −500 −7108 | −275 233 −8150 | 1008 43 −894 | −1926 −381 −1115 | −1415 399 −701 | 1528 106 −1378 | −1618 −626 * | 244 210 * | −1673 −466 | −815 −720 | 1897 275 | −1530 394 | 299 45 | −244 96 | −371 359 | −391 117 | 322 −369 | −1934 −294 | −1306 −249 | 346 |
| 341(G) | −1709 −149 −16 | −2639 −500 −7108 | 1362 233 −8150 | −690 43 −894 | −3785 −381 −1115 | 3257 399 −701 | −1671 106 −1378 | −3805 −626 * | −1946 210 * | −3792 −466 | −3137 −720 | −980 275 | −2480 394 | −1424 45 | −2576 96 | −1630 359 | −1936 117 | −3150 −369 | −3628 −294 | −3155 −249 | 347 |
| 342(F) | −942 −149 −16 | −799 −500 −7108 | −2828 233 −8150 | −2226 43 −894 | 1797 −381 −1115 | −2476 399 −701 | −1269 106 −1378 | 1109 −626 * | 581 210 * | 1793 −466 | 516 −720 | −1952 275 | −2453 394 | −1557 45 | −1815 96 | −1558 359 | −875 117 | 52 −369 | −1138 −294 | −794 −249 | 348 |
| 343(L) | −2451 −149 −16 | −1983 −500 −7108 | −4707 233 −8150 | −4186 43 −894 | −582 −381 −1115 | −4409 399 −701 | −3259 106 −1378 | 1510 −626 * | −3884 210 * | 2778 −466 | 592 −720 | −4069 275 | −3865 394 | −3091 45 | −3590 96 | −3698 359 | −2355 117 | −150 −369 | −2226 −294 | −2214 −249 | 349 |
| 344(H) | −3205 −149 −16 | −3079 −500 −7108 | −2723 233 −8150 | −2890 43 −894 | −2110 −381 −1115 | −3046 399 −701 | 5295 106 −1378 | −4135 −626 * | −2617 210 * | −3813 −466 | −3561 −720 | −2886 275 | −3482 394 | −2833 45 | −2620 96 | −3291 359 | −3356 117 | −3895 −369 | −2397 −294 | −1681 −249 | 350 |
| 345(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 351 |
| 346(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −3014 275 | −3014 394 | −2039 45 | −3232 96 | −2593 359 | −2938 117 | −4046 −369 | −3710 −294 | −3552 −249 | 352 |
| 347(C) | 774 −149 −16 | 4452 −500 −7108 | −2162 233 −8150 | −1688 43 −894 | −1962 −381 −1115 | −1478 399 −701 | −1302 106 −1378 | −1474 −626 * | −944 210 * | −1796 −466 | −1088 −720 | −1351 275 | −1979 394 | −1147 45 | 1684 96 | −732 359 | −719 117 | −1116 −369 | −2225 −294 | −1881 −249 | 353 |
| 348(L) | −2387 −149 −16 | −1922 −500 −7108 | −4674 233 −8150 | −4155 43 −894 | −617 −381 −1115 | −4366 399 −701 | −3250 106 −1378 | 1889 −626 * | −3865 210 * | 2650 −466 | 558 −720 | −4023 275 | −3847 394 | −3098 45 | −3586 96 | −3647 359 | −2296 117 | −38 −369 | −2247 −294 | −2224 −249 | 354 |
| 349(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 355 |

TABLE 9-continued

| | | | | | | | | | | | | | | | | | | | |
|---|---|---|---|---|---|---|---|---|---|---|---|---|---|---|---|---|---|---|---|
| 350(C) | −1489<br>−149<br>−16<br>−571 | 2972<br>−500<br>−7108 | −4007<br>233<br>−8150 | −3563<br>43<br>−894 | −1524<br>−381<br>−1115 | −3541<br>399<br>−701 | −2939<br>106<br>−1378 | 2612<br>−626<br>* | −3350<br>210<br>* | −617<br>−466 | −413<br>−720 | −3224<br>275 | −3470<br>394 | −3129<br>45 | −3335<br>96 | −2770<br>359 | −1475<br>117 | 2269<br>−369 | −2657<br>−294 | −2248<br>−249 | 356 |
| 351(T) | −364<br>−149<br>−16 | −979<br>−500<br>−7108 | −2232<br>233<br>−8150 | −2250<br>43<br>−894 | −2904<br>−381<br>−1115 | −1245<br>399<br>−701 | −2090<br>106<br>−1378 | −2559<br>−626<br>* | −2191<br>210<br>* | −2881<br>−466 | −2075<br>−720 | −1571<br>275 | −1964<br>394 | −1991<br>45 | −2260<br>96 | 905<br>359 | 3428<br>117 | −1762<br>−369 | −3159<br>−294 | −2858<br>−249 | 357 |
| 352(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 358 |
| 353(K) | −1716<br>−149<br>−16 | −2632<br>−500<br>−7108 | −2004<br>233<br>−8150 | −1008<br>43<br>−894 | −3336<br>−381<br>−1115 | −2379<br>399<br>−701 | −444<br>106<br>−1378 | −2764<br>−626<br>* | 2775<br>210<br>* | −2484<br>−466 | −1756<br>−720 | −1035<br>275 | −2357<br>394 | 2151<br>45 | 1811<br>96 | −1592<br>359 | −1477<br>117 | −2481<br>−369 | −2391<br>−294 | −2172<br>−249 | 359 |
| 354(T) | −1213<br>−149<br>−16 | −1674<br>−500<br>−7108 | −2755<br>233<br>−8150 | −2906<br>43<br>−894 | −3163<br>−381<br>−1115 | −1922<br>399<br>−701 | −2659<br>106<br>−1378 | −2698<br>−626<br>* | −2788<br>210<br>* | −3105<br>−466 | −2612<br>−720 | −2311<br>275 | −2600<br>394 | −2708<br>45 | −2753<br>96 | −1463<br>359 | 3819<br>117 | −2197<br>−369 | −3286<br>−294 | −3156<br>−249 | 360 |
| 355(V) | −1771<br>−149<br>−16 | −1339<br>−500<br>−7108 | −4275<br>233<br>−8150 | −3816<br>43<br>−894 | −1235<br>−381<br>−1115 | −3919<br>399<br>−701 | −3194<br>106<br>−1378 | 2139<br>−626<br>* | −3617<br>210<br>* | 1520<br>−466 | −66<br>−720 | −3558<br>275 | −3681<br>394 | −3244<br>45 | −3547<br>96 | −3164<br>359 | −1733<br>117 | 2390<br>−369 | −2634<br>−294 | −2369<br>−249 | 361 |
| 356(A) | 3438<br>−149<br>−16 | −1472<br>−500<br>−7108 | −2846<br>233<br>−8150 | −3040<br>43<br>−894 | −3287<br>−381<br>−1115 | −1726<br>399<br>−701 | −2735<br>106<br>−1378 | −2840<br>−626<br>* | −3028<br>210<br>* | −3257<br>−466 | −2662<br>−720 | −2236<br>275 | −2447<br>394 | −2798<br>45 | −2944<br>96 | −1216<br>359 | −1387<br>117 | −2183<br>−369 | −3405<br>−294 | −3320<br>−249 | 362 |
| 357(E) | −2641<br>−149<br>−16 | −3308<br>−500<br>−7108 | −896<br>233<br>−8150 | 3732<br>43<br>−894 | −3966<br>−381<br>−1115 | −2458<br>399<br>−701 | −2043<br>106<br>−1378 | −4105<br>−626<br>* | −2128<br>210<br>* | −4016<br>−466 | −3555<br>−720 | −1531<br>275 | −2959<br>394 | −1842<br>45 | −2560<br>96 | −2479<br>359 | −2750<br>117 | −3722<br>−369 | −3563<br>−294 | −3385<br>−249 | 363 |
| 358(N) | −823<br>−149<br>−16 | −1917<br>−500<br>−7108 | −96<br>233<br>−8150 | 1188<br>43<br>−894 | −2187<br>−381<br>−1115 | −1547<br>399<br>−701 | −506<br>106<br>−1378 | −1711<br>−626<br>* | −265<br>210<br>* | −1955<br>−466 | −1191<br>−720 | 2711<br>275 | −1815<br>394 | −144<br>45 | −747<br>96 | −757<br>359 | −815<br>117 | 1140<br>−369 | −2297<br>−294 | −1666<br>−249 | 364 |
| 359(L) | −2153<br>−149<br>−16 | −1779<br>−500<br>−7108 | −4360<br>233<br>−8150 | −3884<br>43<br>−894 | −675<br>−381<br>−1115 | −3965<br>399<br>−701 | −3012<br>106<br>−1378 | 392<br>−626<br>* | −3561<br>210<br>* | 2726<br>−466 | 467<br>−720 | −3673<br>275 | −3662<br>394 | −2955<br>45 | −3355<br>96 | −3239<br>359 | −2102<br>117 | 1281<br>−369 | −2207<br>−294 | −2099<br>−249 | 365 |
| 360(E) | 1136<br>−149<br>−16 | −2084<br>−500<br>−7108 | −175<br>233<br>−8150 | 2027<br>43<br>−894 | −2436<br>−381<br>−1115 | −1510<br>399<br>−701 | −274<br>106<br>−1378 | −2147<br>−626<br>* | 1525<br>210<br>* | −2118<br>−466 | −1254<br>−720 | −175<br>275 | −1692<br>394 | 152<br>45 | −251<br>96 | −593<br>359 | −670<br>117 | −1736<br>−369 | −2296<br>−294 | −1650<br>−249 | 366 |
| 361(H) | 893<br>−149<br>−16 | −1761<br>−500<br>−7108 | 1357<br>233<br>−8150 | 214<br>43<br>−894 | −2092<br>−381<br>−1115 | −1387<br>399<br>−701 | 1862<br>106<br>−1378 | −1810<br>−626<br>* | 229<br>210<br>* | −1825<br>−466 | −942<br>−720 | −83<br>275 | −1527<br>394 | 293<br>45 | −273<br>96 | 640<br>359 | 793<br>117 | −1409<br>−369 | −2050<br>−294 | −1397<br>−249 | 367 |
| 362(I) | 608<br>−149<br>−16 | −458<br>−500<br>−7108 | −2776<br>233<br>−8150 | −2176<br>43<br>−894 | 1666<br>−381<br>−1115 | −2202<br>399<br>−701 | −1113<br>106<br>−1378 | 1712<br>−626<br>* | −1836<br>210<br>* | −222<br>−466 | 338<br>−720 | −1782<br>275 | −2245<br>394 | −1512<br>45 | −1731<br>96 | −1292<br>359 | 867<br>117 | 1366<br>−369 | −1036<br>−294 | −684<br>−249 | 368 |
| 363(P) | −922<br>−149<br>−16 | −1912<br>−500<br>−7108 | 1681<br>233<br>−8150 | −141<br>43<br>−894 | −2123<br>−381<br>−1115 | −1604<br>399<br>−701 | −687<br>106<br>−1378 | −1787<br>−626<br>* | −550<br>210<br>* | 187<br>−466 | −1245<br>−720 | −427<br>275 | 2677<br>394 | −363<br>45 | −1049<br>96 | −882<br>359 | −947<br>117 | −1524<br>−369 | −2338<br>−294 | −1711<br>−249 | 369 |
| 364(D) | −1692<br>−149<br>−16 | −3605<br>−500<br>−7108 | 3364<br>233<br>−8150 | 1256<br>43<br>−894 | −3770<br>−381<br>−1115 | −1599<br>399<br>−701 | −957<br>106<br>−1378 | −3700<br>−626<br>* | −1216<br>210<br>* | −3569<br>−466 | −2909<br>−720 | 1025<br>275 | −2138<br>394 | −628<br>45 | −2083<br>96 | −1346<br>359 | −1761<br>117 | −3174<br>−369 | −3765<br>−294 | −2738<br>−249 | 370 |
| 365(Q) | −877<br>−149<br>−16 | −1646<br>−500<br>−7108 | −633<br>233<br>−8150 | 499<br>43<br>−894 | −1610<br>−381<br>−1115 | −1781<br>399<br>−701 | −505<br>106<br>−1378 | −1210<br>−626<br>* | −63<br>210<br>* | 1648<br>−466 | −649<br>−720 | −558<br>275 | −1931<br>394 | 2241<br>45 | −360<br>96 | −907<br>359 | −814<br>117 | −1097<br>−369 | −1882<br>−294 | −1385<br>−249 | 371 |
| 366(P) | −648<br>−149<br>−16 | −2019<br>−500<br>−7108 | 1139<br>233<br>−1646 | 203<br>43<br>−894 | −2354<br>−381<br>−1115 | −1436<br>399<br>−701 | −285<br>106<br>−1378 | −2089<br>−626<br>* | 29<br>210<br>* | −2086<br>−466 | −1217<br>−720 | −114<br>275 | 1965<br>394 | 1445<br>45 | −492<br>96 | −529<br>359 | 1244<br>117 | −1672<br>−369 | −2300<br>−294 | −1616<br>−249 | 372 |

TABLE 9-continued

| | | | | | | | | | | | | | | | | | | | |
|---|---|---|---|---|---|---|---|---|---|---|---|---|---|---|---|---|---|---|---|
| 367(R) | -422 -149 -23 | -1009 -500 -6560 | -851 233 -7602 | -304 43 -894 | 1406 -381 -1115 | -1496 399 -341 | -183 106 -2249 | -740 -626 * | 147 210 * | -894 -466 | -230 -720 | -440 275 | 775 394 | 21 45 | 2009 96 | -539 359 | -381 117 | -568 -369 | -1136 -294 | -521 -249 | 373 |
| 368(D) | 1472 -149 -16 | -1668 -500 -7108 | 1835 233 -8150 | -70 43 -894 | -2356 -381 -1115 | -1385 399 -701 | -511 106 -1378 | -2062 -626 * | -246 210 * | -2128 -466 | -1275 -720 | -318 275 | 1353 394 | -118 45 | -746 96 | -526 359 | 425 117 | -1602 -369 | -2380 -294 | -1752 -249 | 374 |
| 369(G) | -1044 -149 -16 | -2230 -500 -7108 | 2141 233 -8150 | -100 43 -894 | -3222 -381 -1115 | 2291 399 -701 | -982 106 -1378 | -3045 -626 * | -1033 210 * | -3050 -466 | -2258 -720 | -395 275 | -1985 394 | -644 45 | -1669 96 | 858 359 | -1207 117 | -2428 -369 | -3250 -294 | -2493 -249 | 375 |
| 370(Q) | -2562 -149 -16 | -2904 -500 -7108 | -1886 233 -8150 | -1971 43 -894 | -3251 -381 -1115 | -2661 399 -701 | -2079 106 -1378 | -3690 -626 * | -1565 210 * | -3469 -466 | -3081 -720 | -2107 275 | -3091 394 | 4371 45 | -1665 96 | -2585 359 | -2674 117 | -3411 -369 | -3077 -294 | -2821 -249 | 376 |
| 371(D) | -1275 -149 -16 | -2955 -500 -7108 | 2862 233 -8150 | 1330 43 -894 | -3205 -381 -1115 | -1556 399 -701 | -670 106 -1378 | -3029 -626 * | 1509 210 * | -2936 -466 | -2141 -720 | -158 275 | -1955 394 | -290 45 | -1213 96 | -1025 359 | -1281 117 | -2554 -369 | -3111 -294 | -2272 -249 | 377 |
| 372(V) | -1738 -149 -16 | -1298 -500 -7108 | -4281 233 -8150 | -3921 43 -894 | -1737 -381 -1115 | -3979 399 -701 | -3665 106 -1378 | 1917 -626 * | -3774 210 * | -601 -466 | -528 -720 | -3671 275 | -3834 394 | -3628 45 | -3843 96 | -3293 359 | -1735 117 | 3205 -369 | -3215 -294 | -2770 -249 | 378 |
| 373(I) | -2091 -149 -16 | -1746 -500 -7108 | -3971 233 -8150 | -3840 43 -894 | -1676 -381 -1115 | -3532 399 -701 | -3289 106 -1378 | 3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 379 |
| 374(M) | -584 -149 -16 | -1354 -500 -7108 | -847 233 -8150 | -246 43 -894 | -1467 -381 -1115 | -1659 399 -701 | 2505 106 -1378 | -1087 -626 * | 212 210 * | -374 -466 | 2571 -720 | -449 275 | -1729 394 | 1171 45 | 1074 96 | -634 359 | -507 117 | -876 -369 | -1617 -294 | -1128 -249 | 380 |
| 375(P) | -910 -149 -16 | -2031 -500 -7108 | -73 233 -8150 | 1195 43 -894 | -2792 -381 -1115 | -1488 399 -701 | -794 106 -1378 | -2539 -626 * | -629 210 * | -2588 -466 | -1788 -720 | -401 275 | 3005 394 | -439 45 | -1131 96 | 612 359 | -1014 117 | -2050 -369 | -2815 -294 | -2151 -249 | 381 |
| 376(W) | -1588 -149 -16 | -1300 -500 -7108 | -3783 233 -8150 | -3197 43 -894 | -329 -381 -1115 | -3245 399 -701 | -1926 106 -1378 | 2071 -626 * | -2827 210 * | 1901 -466 | 558 -720 | -2822 275 | -3072 394 | -2297 45 | -2616 96 | -2381 359 | -1508 117 | -111 -369 | 3483 -294 | -1042 -249 | 382 |
| 377(E) | -1024 -149 -16 | -2640 -500 -7108 | 1844 233 -8150 | 2310 43 -894 | -2908 -381 -1115 | -1498 399 -701 | -505 106 -1378 | -2711 -626 * | -344 210 * | -2636 -466 | -1791 -720 | -107 275 | -1824 394 | 1521 45 | -957 96 | 207 359 | -1011 117 | -2243 -369 | -2817 -294 | -2021 -249 | 383 |
| 378(N) | -826 -149 -16 | -2349 -500 -7108 | 1089 233 -8150 | 227 43 -894 | -2651 -381 -1115 | -1487 399 -701 | -341 106 -1378 | -2416 -626 * | 1494 210 * | -2346 -466 | -1475 -720 | 2601 275 | -1724 394 | 1005 45 | -522 96 | -657 359 | -787 117 | -1968 -369 | -2511 -294 | -1791 -249 | 384 |
| 379(P) | 1932 -149 -16 | -1116 -500 -7108 | -2232 233 -8150 | -2301 43 -894 | -3058 -381 -1115 | -1358 399 -701 | -2206 106 -1378 | -2706 -626 * | -2336 210 * | -3009 -466 | -2238 -720 | -1674 275 | 3274 394 | -2114 45 | -2406 96 | -739 359 | -914 117 | -1913 -369 | -3260 -294 | -3019 -249 | 385 |
| 380(V) | -914 -149 -16 | -773 -500 -7108 | -2713 233 -8150 | -2129 43 -894 | -712 -381 -1115 | -2505 399 -701 | -1388 106 -1378 | 1452 -626 * | 1084 210 * | 1324 -466 | 204 -720 | -1926 275 | -2507 394 | -1580 45 | -1808 96 | -1591 359 | -859 117 | 1713 -369 | -1424 -294 | -1081 -249 | 386 |
| 381(Y) | -1484 -149 -16 | -2331 -500 -7108 | -1762 233 -8150 | -887 43 -894 | -2436 -381 -1115 | -2254 399 -701 | -420 106 -1378 | -2325 -626 * | 2137 210 * | -2195 -466 | -1475 -720 | -949 275 | -2258 394 | -39 45 | 1983 96 | -1411 359 | -1295 117 | -2075 -369 | -2087 -294 | 2868 -249 | 387 |
| 382(E) | 1256 -149 -16 | -1890 -500 -7108 | -206 233 -8150 | 1353 43 -894 | -2196 -381 -1115 | -1401 399 -701 | -89 106 -1378 | -1930 -626 * | 812 210 * | -1898 -466 | -996 -720 | -45 275 | 547 394 | 1252 45 | -162 96 | -356 359 | -414 117 | -1507 -369 | -2083 -294 | -1416 -249 | 388 |
| 383(Q) | -752 -149 -16 | -2272 -500 -7108 | 1586 233 -8150 | 1407 43 -894 | -2561 -381 -1115 | -1448 399 -701 | -308 106 -1378 | -2329 -626 * | -23 210 * | -2276 -466 | -1396 -720 | -71 275 | -1677 394 | 1749 45 | -577 96 | -590 359 | 1569 117 | -1881 -369 | -2459 -294 | -1727 -249 | 389 |

TABLE 9-continued

| | | | | | | | | | | | | | | | | |
|---|---|---|---|---|---|---|---|---|---|---|---|---|---|---|---|---|
| 384(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 390 |
| 385(H) | −964<br>−149<br>−16 | −2089<br>−500<br>−7108 | −200<br>233<br>−8150 | −136<br>43<br>−894 | −2264<br>−381<br>−1115 | −1600<br>399<br>−701 | 3833<br>106<br>−1378 | −2320<br>−626<br>* | −296<br>210<br>* | −2338<br>−466 | −1558<br>−720 | 1362<br>275 | 1479<br>394 | −276<br>45 | −699<br>96 | −881<br>359 | −992<br>117 | −1924<br>−369 | −2364<br>−294 | −1652<br>−249 | 391 |
| 386(L) | −2451<br>−149<br>−16 | −1983<br>−500<br>−7108 | −4707<br>233<br>−8150 | −4186<br>43<br>−894 | −582<br>−381<br>−1115 | −4409<br>399<br>−701 | −3259<br>106<br>−1378 | 1510<br>−626<br>* | −3884<br>210<br>* | 2778<br>−466 | 592<br>−720 | −4069<br>275 | −3865<br>394 | −3091<br>45 | −3590<br>96 | −3698<br>359 | −2355<br>117 | −150<br>−369 | −2226<br>−294 | −2214<br>−249 | 392 |
| 387(Q) | 1643<br>−149<br>−16 | −1017<br>−500<br>−7108 | −1196<br>233<br>−8150 | −721<br>43<br>−894 | −1189<br>−381<br>−1115 | −1714<br>399<br>−701 | −668<br>106<br>−1378 | 1336<br>−626<br>* | −497<br>210<br>* | −907<br>−466 | −297<br>−720 | −823<br>275 | −1893<br>394 | 2044<br>45 | −794<br>96 | −784<br>359 | −569<br>117 | −339<br>−369 | −1579<br>−294 | −1135<br>−249 | 393 |
| 388(I) | −1760<br>−149<br>−16 | −1308<br>−500<br>−7108 | −4323<br>233<br>−8150 | −3961<br>43<br>−894 | −1730<br>−381<br>−1115 | −4039<br>399<br>−701 | −3721<br>106<br>−1378 | 3156<br>−626<br>* | −3825<br>210<br>* | −575<br>−466 | −512<br>−720 | −3720<br>275 | −3867<br>394 | −3669<br>45 | −3893<br>96 | −3356<br>359 | −1753<br>117 | 2241<br>−369 | −3236<br>−294 | −2802<br>−249 | 394 |
| 389(L) | −2871<br>−149<br>−16 | −2457<br>−500<br>−7108 | −4231<br>233<br>−8150 | −4103<br>43<br>−894 | −1033<br>−381<br>−1115 | −3803<br>399<br>−701 | −3165<br>106<br>−1378 | −541<br>−626<br>* | −3734<br>210<br>* | 3130<br>−466 | −31<br>−720 | −3935<br>275 | −3797<br>394 | −3286<br>45 | −3484<br>96 | −3713<br>359 | −2869<br>117 | −1136<br>−369 | −2394<br>−294 | −2220<br>−249 | 395 |
| 390(K) | −1259<br>−149<br>−16 | −2215<br>−500<br>−7108 | −1267<br>233<br>−8150 | −676<br>43<br>−894 | −970<br>−381<br>−1115 | −2105<br>399<br>−701 | 1794<br>106<br>−1378 | −2040<br>−626<br>* | 2549<br>210<br>* | −1955<br>−466 | −1282<br>−720 | −808<br>275 | −2165<br>394 | −167<br>45 | 114<br>96 | −1192<br>359 | −1140<br>117 | −1801<br>−369 | −1301<br>−294 | 2517<br>−249 | 396 |
| 391(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 397 |
| 392(N) | −2171<br>−149<br>−16 | −2655<br>−500<br>−7108 | −1458<br>233<br>−8150 | −1748<br>43<br>−894 | −3334<br>−381<br>−1115 | −2364<br>399<br>−701 | −2267<br>106<br>−1378 | −3943<br>−626<br>* | −2365<br>210<br>* | −3936<br>−466 | −3437<br>−720 | 4205<br>275 | −2932<br>394 | −2205<br>45 | −2608<br>96 | −2224<br>359 | −2439<br>117 | −3392<br>−369 | −3253<br>−294 | −2909<br>−249 | 398 |
| 393(L) | −2871<br>−149<br>−16 | −2457<br>−500<br>−7108 | −4231<br>233<br>−8150 | −4103<br>43<br>−894 | −1033<br>−381<br>−1115 | −3803<br>399<br>−701 | −3165<br>106<br>−1378 | −541<br>−626<br>* | −3734<br>210<br>* | 3130<br>−466 | −31<br>−720 | −3935<br>275 | −3797<br>394 | −3286<br>45 | −3484<br>96 | −3713<br>359 | −2869<br>117 | −1136<br>−369 | −2394<br>−294 | −2220<br>−249 | 399 |
| 394(A) | 3121<br>−149<br>−16 | −934<br>−500<br>−7108 | −2489<br>233<br>−8150 | −2561<br>43<br>−894 | −3081<br>−381<br>−1115 | −1203<br>399<br>−701 | −2295<br>106<br>−1378 | −2766<br>−626<br>* | −2533<br>210<br>* | −3080<br>−466 | −2234<br>−720 | −1669<br>275 | −1953<br>394 | −2234<br>45 | −2533<br>96 | 936<br>359 | −746<br>117 | −1844<br>−369 | −3331<br>−294 | −3090<br>−249 | 400 |
| 395(E) | −522<br>−149<br>−16 | −1773<br>−500<br>−7108 | −240<br>233<br>−8150 | 1676<br>43<br>−894 | −2248<br>−381<br>−1115 | −1396<br>399<br>−701 | −289<br>106<br>−1378 | −1968<br>−626<br>* | 50<br>210<br>* | −1989<br>−466 | −1115<br>−720 | −174<br>275 | 1198<br>394 | 131<br>45 | −448<br>96 | 1226<br>359 | 677<br>117 | −1538<br>−369 | −2214<br>−294 | −1565<br>−249 | 401 |
| 396(E) | −1481<br>−149<br>−16 | −3230<br>−500<br>−7108 | 1425<br>233<br>−8150 | 2936<br>43<br>−894 | −3481<br>−381<br>−1115 | 751<br>399<br>−701 | −843<br>106<br>−1378 | −3354<br>−626<br>* | −954<br>210<br>* | −3256<br>−466 | −2520<br>−720 | −187<br>275 | −2057<br>394 | −492<br>45 | −1711<br>96 | −1193<br>359 | −1527<br>117 | −2852<br>−369 | −3445<br>−294 | −2523<br>−249 | 402 |
| 397(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 403 |
| 398(A) | 2847<br>−149<br>−16 | −932<br>−500<br>−7108 | −2454<br>233<br>−8150 | −2477<br>43<br>−894 | −3066<br>−381<br>−1115 | −1198<br>399<br>−701 | −2236<br>106<br>−1378 | −2763<br>−626<br>* | −2439<br>210<br>* | −3057<br>−466 | −2202<br>−720 | −1635<br>275 | −1940<br>394 | −2152<br>45 | −2471<br>96 | 1777<br>359 | −731<br>117 | −1840<br>−369 | −3306<br>−294 | −3056<br>−249 | 404 |
| 399(V) | −1771<br>−149<br>−16 | −1603<br>−500<br>−7108 | −3750<br>233<br>−8150 | −3689<br>43<br>−894 | −2037<br>−381<br>−1115 | −3050<br>399<br>−701 | −3231<br>106<br>−1378 | 403<br>−626<br>* | −3479<br>210<br>* | −1154<br>−466 | −1076<br>−720 | −3246<br>275 | −3399<br>394 | −3383<br>45 | −3437<br>96 | −2628<br>359 | −1917<br>117 | 3536<br>−369 | −3074<br>−294 | −2677<br>−249 | 405 |
| 400(A) | 3438<br>−149<br>−16 | −1472<br>−500<br>−7108 | −2846<br>233<br>−8150 | −3040<br>43<br>−894 | −3287<br>−381<br>−1115 | −1726<br>399<br>−701 | −2735<br>106<br>−1378 | −2840<br>−626<br>* | −3028<br>210<br>* | −3257<br>−466 | −2662<br>−720 | −2236<br>275 | −2447<br>394 | −2798<br>45 | −2944<br>96 | −1216<br>359 | −1387<br>117 | −2183<br>−369 | −3405<br>−294 | −3320<br>−249 | 406 |

TABLE 9-continued

| | | | | | | | | | | | | | | | | | | | | | |
|---|---|---|---|---|---|---|---|---|---|---|---|---|---|---|---|---|---|---|---|---|---|
| 401(K) | −2620<br>−149<br>−16 | −2961<br>−500<br>−7108 | −2461<br>233<br>−8150 | −2046<br>43<br>−894 | −3743<br>−381<br>−1115 | −2791<br>399<br>−701 | −1570<br>106<br>−1378 | −3603<br>−626<br>* | 3784<br>210<br>* | −3387<br>−466 | −2839<br>−720 | −2048<br>275 | −3039<br>394 | −1260<br>45 | −465<br>96 | −2604<br>359 | −2536<br>117 | −3331<br>−369 | −3001<br>−294 | −2988<br>−249 | 407 |
| — | | | | | | | | | | | | | | | | | | | | | |
| 402(I) | −1761<br>−149<br>−16 | −1312<br>−500<br>−7108 | −4317<br>233<br>−8150 | −3954<br>43<br>−894 | −1713<br>−381<br>−1115 | −4027<br>399<br>−701 | −3703<br>106<br>−1378 | 3225<br>−626<br>* | −3814<br>210<br>* | −556<br>−466 | −498<br>−720 | −3712<br>275 | −3859<br>394 | −3653<br>45 | −3877<br>96 | −3344<br>359 | −1754<br>117 | 2110<br>−369 | −3216<br>−294 | −2787<br>−249 | 408 |
| — | | | | | | | | | | | | | | | | | | | | | |
| 403(S) | −348<br>−149<br>−16 | −981<br>−500<br>−7108 | −2200<br>233<br>−8150 | −2194<br>43<br>−894 | −2989<br>−381<br>−1115 | −1227<br>399<br>−701 | −2073<br>106<br>−1378 | −2686<br>−626<br>* | −2157<br>210<br>* | −2970<br>−466 | −2136<br>−720 | −1541<br>275 | −1946<br>394 | −1946<br>45 | −2253<br>96 | 3060<br>359 | 1398<br>117 | −1824<br>−369 | −3217<br>−294 | −2916<br>−249 | 409 |
| — | | | | | | | | | | | | | | | | | | | | | |
| 404(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 410 |
| — | | | | | | | | | | | | | | | | | | | | | |
| 405(V) | −917<br>−149<br>−16 | −809<br>−500<br>−7108 | −2556<br>233<br>−8150 | −1976<br>43<br>−894 | −827<br>−381<br>−1115 | −2491<br>399<br>−701 | −1367<br>106<br>−1378 | 1339<br>−626<br>* | 1455<br>210<br>* | 721<br>−466 | 94<br>−720 | −1841<br>275 | −2501<br>394 | −1487<br>45 | −1710<br>96 | −1570<br>359 | −863<br>117 | 2038<br>−369 | −1514<br>−294 | −1151<br>−249 | 411 |
| — | | | | | | | | | | | | | | | | | | | | | |
| 406(K) | −1386<br>−149<br>−16 | −2643<br>−500<br>−7108 | −447<br>233<br>−8150 | 1824<br>43<br>−894 | −3108<br>−381<br>−1115 | −1893<br>399<br>−701 | −570<br>106<br>−1378 | −2762<br>−626<br>* | 2860<br>210<br>* | −2616<br>−466 | −1848<br>−720 | −552<br>275 | −2117<br>394 | −166<br>45 | −3<br>96 | −1217<br>359 | −1300<br>117 | −2388<br>−369 | −2647<br>−294 | −2154<br>−249 | 412 |
| — | | | | | | | | | | | | | | | | | | | | | |
| 407(N) | −537<br>−149<br>−16 | −1563<br>−500<br>−7108 | −449<br>233<br>−8150 | −36<br>43<br>−894 | −1889<br>−381<br>−1115 | 1143<br>399<br>−701 | −307<br>106<br>−1378 | −1529<br>−626<br>* | 932<br>210<br>* | −1655<br>−466 | −844<br>−720 | 1794<br>275 | −1658<br>394 | 73<br>45 | −356<br>96 | −518<br>359 | −516<br>117 | 924<br>−369 | −1962<br>−294 | −1392<br>−249 | 413 |
| — | | | | | | | | | | | | | | | | | | | | | |
| 408(P) | −894<br>−149<br>−16 | −2181<br>−500<br>−7108 | −369<br>233<br>−8150 | 1705<br>43<br>−894 | −2576<br>−381<br>−1115 | −1650<br>399<br>−701 | −357<br>106<br>−1378 | −2268<br>−626<br>* | 243<br>210<br>* | −2210<br>−466 | −1375<br>−720 | −330<br>275 | 2093<br>394 | 63<br>45 | 1619<br>96 | −774<br>359 | −835<br>117 | −1876<br>−369 | −2347<br>−294 | −1769<br>−249 | 414 |
| — | | | | | | | | | | | | | | | | | | | | | |
| 409(V) | −419<br>−149<br>−16 | −634<br>−500<br>−7108 | −1376<br>233<br>−8150 | −807<br>43<br>−894 | 1053<br>−381<br>−1115 | −1737<br>399<br>−701 | −499<br>106<br>−1378 | −198<br>−626<br>* | −623<br>210<br>* | −505<br>−466 | 178<br>−720 | 600<br>275 | −1807<br>394 | −475<br>45 | 475<br>96 | 313<br>359 | −360<br>117 | 1389<br>−369 | −1016<br>−294 | 1303<br>−249 | 415 |
| — | | | | | | | | | | | | | | | | | | | | | |
| 410(I) | −1282<br>−149<br>−16 | −1082<br>−500<br>−7108 | −3022<br>233<br>−8150 | −2555<br>43<br>−894 | 2426<br>−381<br>−1115 | −2683<br>399<br>−701 | 1767<br>106<br>−1378 | 2555<br>−626<br>* | −2191<br>210<br>* | −443<br>−466 | −88<br>−720 | −2038<br>275 | −2692<br>394 | −1794<br>45 | −2075<br>96 | −1793<br>359 | −1220<br>117 | −317<br>−369 | −361<br>−294 | 552<br>−249 | 416 |
| — | | | | | | | | | | | | | | | | | | | | | |
| 411(T) | −499<br>−149<br>−16 | −1595<br>−500<br>−7108 | −431<br>233<br>−8150 | 966<br>43<br>−894 | −1830<br>−381<br>−1115 | −1487<br>399<br>−701 | −185<br>106<br>−1378 | −1449<br>−626<br>* | 1092<br>210<br>* | −1574<br>−466 | −754<br>−720 | −207<br>275 | −1601<br>394 | 213<br>45 | −206<br>96 | −458<br>359 | 2067<br>117 | 159<br>−369 | −1877<br>−294 | −1296<br>−249 | 417 |
| — | | | | | | | | | | | | | | | | | | | | | |
| 412(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210<br>* | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 418 |
| — | | | | | | | | | | | | | | | | | | | | | |
| 413(P) | −632<br>−149<br>−16 | −1230<br>−500<br>−7108 | −2074<br>233<br>−8150 | −2144<br>43<br>−894 | −2996<br>−381<br>−1115 | −1453<br>399<br>−701 | −2116<br>106<br>−1378 | −2631<br>−626<br>* | −2128<br>210<br>* | −2928<br>−466 | −2213<br>−720 | −1658<br>275 | 3610<br>394 | −2006<br>45 | −2221<br>96 | −852<br>359 | 1302<br>117 | −1931<br>−369 | −3185<br>−294 | −2917<br>−249 | 419 |
| — | | | | | | | | | | | | | | | | | | | | | |
| 414(A) | 3438<br>−149<br>−16 | −1472<br>−500<br>−7108 | −2846<br>233<br>−8150 | −3040<br>43<br>−894 | −3287<br>−381<br>−1115 | −1726<br>399<br>−701 | −2735<br>106<br>−1378 | −2840<br>−626<br>* | −3028<br>210<br>* | −3257<br>−466 | −2662<br>−720 | −2236<br>275 | −2447<br>394 | −2798<br>45 | −2944<br>96 | −1216<br>359 | −1387<br>117 | −2183<br>−369 | −3405<br>−294 | −3320<br>−249 | 420 |
| — | | | | | | | | | | | | | | | | | | | | | |
| 415(R) | −1454<br>−149<br>−16 | −2316<br>−500<br>−7108 | −1780<br>233<br>−8150 | −878<br>43<br>−894 | −2834<br>−381<br>−1115 | −2232<br>399<br>−701 | −428<br>106<br>−1378 | −2292<br>−626<br>* | 2281<br>210<br>* | −2200<br>−466 | −1473<br>−720 | −940<br>275 | −2240<br>394 | −17<br>45 | 2627<br>96 | −1386<br>359 | −1270<br>117 | 588<br>−369 | −2249<br>−294 | −1960<br>−249 | 421 |
| — | | | | | | | | | | | | | | | | | | | | | |
| 416(V) | −1771<br>−149<br>−16 | −1603<br>−500<br>−7108 | −3750<br>233<br>−8150 | −3689<br>43<br>−894 | −2037<br>−381<br>−1115 | −3050<br>399<br>−701 | −3231<br>106<br>−1378 | 403<br>−626<br>* | −3479<br>210<br>* | −1154<br>−466 | −1076<br>−720 | −3246<br>275 | −3399<br>394 | −3383<br>45 | −3437<br>96 | −2628<br>359 | −1917<br>117 | 3536<br>−369 | −3074<br>−294 | −2677<br>−249 | 422 |
| — | | | | | | | | | | | | | | | | | | | | | |
| 417(F) | −3342<br>−149<br>−16 | −2776<br>−500<br>−7108 | −4026<br>233<br>−8150 | −4232<br>43<br>−894 | 4354<br>−381<br>−1115 | −3545<br>399<br>−701 | −1431<br>106<br>−1378 | −2315<br>−626<br>* | −4038<br>210<br>* | −1801<br>−466 | −1900<br>−720 | −3299<br>275 | −3780<br>394 | −3350<br>45 | −3645<br>96 | −3490<br>359 | −3420<br>117 | −2566<br>−369 | −739<br>−294 | 349<br>−249 | 423 |
| — | | | | | | | | | | | | | | | | | | | | | |

TABLE 9-continued

| | | | | | | | | | | | | | | | | |
|---|---|---|---|---|---|---|---|---|---|---|---|---|---|---|---|---|
| 418(D) | -1572 -149 -16 | -3426 -500 -7108 | 2573 233 -8150 | 2447 43 -894 | -3613 -381 -1115 | -1583 399 -701 | -879 106 -1378 | -3513 -626 * | -1050 210 * | -3393 -466 | -2684 -720 | 1292 275 | -2085 394 | -535 45 | -1855 96 | -1253 359 | -1623 117 | -3000 -369 | -3585 -294 | -2609 -249 | 424 |
| 419(S) | -879 -149 -16 | -1989 -500 -7108 | 1498 233 -8150 | -177 43 -894 | -3045 -381 -1115 | 1600 399 -701 | -939 106 -1378 | -2843 -626 * | -904 210 * | -2867 -466 | -2046 -720 | -438 275 | -1922 394 | -591 45 | -1483 96 | 2171 359 | -1044 117 | -2226 -369 | -3072 -294 | -2372 -249 | 425 |
| 420(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 426 |
| 421(Q) | -705 -149 -16 | -1925 -500 -7108 | -199 233 -8150 | 2112 43 -894 | 917 -381 -1115 | -1534 399 -701 | -288 106 -1378 | -1824 -626 * | 42 210 * | -1842 -466 | -1054 -720 | -210 275 | -1709 394 | 2163 45 | -420 96 | -611 359 | -656 117 | -1502 -369 | -1997 -294 | -1291 -249 | 427 |
| 422(H) | -569 -149 -16 | -2048 -500 -7108 | 1450 233 -8150 | 1526 43 -894 | -2349 -381 -1115 | -1405 399 -701 | 1830 106 -1378 | -2103 -626 * | 181 210 * | -2058 -466 | -1157 -720 | -37 275 | -1569 394 | 272 45 | -349 96 | 713 359 | 620 117 | -1662 -369 | -2240 -294 | -1537 -249 | 428 |
| 423(C) | 1626 -149 -16 | 2878 -500 -7108 | -2671 233 -8150 | -2107 43 -894 | 1264 -381 -1115 | -1968 399 -701 | -1091 106 -1378 | 233 -626 * | -1777 210 * | -334 -466 | 250 -720 | -1672 275 | -2128 394 | -1459 45 | -1691 96 | -1096 359 | -529 117 | 1209 -369 | -1066 -294 | -704 -249 | 429 |
| 424(M) | -2042 -149 -16 | -1634 -500 -7108 | -4379 233 -8150 | -3826 43 -894 | -659 -381 -1115 | -3976 399 -701 | -2899 106 -1378 | 2765 -626 * | -3546 210 * | 1204 -466 | 3085 -720 | -3605 275 | -3604 394 | -2896 45 | -3318 96 | -3183 359 | -1961 117 | 195 -369 | -2135 -294 | -2058 -249 | 430 |
| 425(E) | 412 -149 -16 | -2447 -500 -7108 | 1356 233 -8150 | 2379 43 -894 | -2747 -381 -1115 | -1477 399 -701 | -445 106 -1378 | -2527 -626 * | -243 210 * | -2477 -466 | -1622 -720 | -107 275 | 855 394 | -36 45 | -831 96 | -730 359 | -894 117 | -2073 -369 | -2668 -294 | -1906 -249 | 431 |
| 426(A) | 2822 -149 -16 | -1031 -500 -7108 | -2418 233 -8150 | -2559 43 -894 | -3226 -381 -1115 | 1898 399 -701 | -2364 106 -1378 | -2941 -626 * | -2626 210 * | -3229 -466 | -2379 -720 | -1722 275 | -2026 394 | -2302 45 | -2634 96 | -654 359 | -848 117 | -1983 -369 | -3415 -294 | -3226 -249 | 432 |
| 427(I) | -1772 -149 -16 | -1325 -500 -7108 | -4307 233 -8150 | -3877 43 -894 | -1405 -381 -1115 | -3993 399 -701 | -3383 106 -1378 | 2935 -626 * | -3705 210 * | 820 -466 | -217 -720 | -3632 275 | -3761 394 | -3400 45 | -3682 96 | -3260 359 | -1742 117 | 2033 -369 | -2838 -294 | -2525 -249 | 433 |
| 428(L) | -875 -149 -16 | -1634 -500 -7108 | -575 233 -8150 | 959 43 -894 | -1581 -381 -1115 | -1769 399 -701 | -525 106 -1378 | -1179 -626 * | -135 210 * | 1884 -466 | -625 -720 | -547 275 | -1931 394 | 1405 45 | -450 96 | -909 359 | -816 117 | -1074 -369 | -1883 -294 | -1383 -249 | 434 |
| 429(A) | 1705 -149 -16 | -1826 -500 -7108 | -180 233 -8150 | 949 43 -894 | -2318 -381 -1115 | -1410 399 -701 | -359 106 -1378 | -2041 -626 * | -53 210 * | -2067 -466 | -1204 -720 | 1001 275 | -1652 394 | 52 45 | -561 96 | 1232 359 | -595 117 | -1609 -369 | -2298 -294 | -1643 -249 | 435 |
| 430(D) | -1074 -149 -16 | -2458 -500 -7108 | 2381 233 -8150 | 60 43 -894 | -2921 -381 -1115 | 1927 399 -701 | -658 106 -1378 | -2710 -626 * | -463 210 * | -2675 -466 | -1860 -720 | -271 275 | -1918 394 | -276 45 | 866 96 | -915 359 | -1100 117 | -2245 -369 | -2845 -294 | -2124 -249 | 436 |
| 431(K) | -688 -149 -16 | -2117 -500 -7108 | 785 233 -8150 | 888 43 -894 | -2469 -381 -1115 | -1529 399 -701 | -187 106 -1378 | -2189 -626 * | 2380 210 * | -2106 -466 | -1221 -720 | -162 275 | -1661 394 | 256 45 | 1134 96 | -553 359 | -619 117 | -1760 -369 | -2240 -294 | -1607 -249 | 437 |
| 432(I) | -2019 -149 -16 | -1582 -500 -7108 | -4380 233 -8150 | -3941 43 -894 | -1000 -381 -1115 | -4086 399 -701 | -3253 106 -1378 | 3295 -626 * | -3671 210 * | 1100 -466 | 145 -720 | -3736 275 | -3783 394 | -3222 45 | -3556 96 | -3378 359 | -1976 117 | 657 -369 | -2517 -294 | -2289 -249 | 438 |
| 433(Q) | -490 -149 -16 | -1797 -500 -7108 | -369 233 -8150 | 171 43 -894 | -2078 -381 -1115 | -1457 399 -701 | 1762 106 -1378 | -1779 -626 * | 1157 210 * | -1780 -466 | -905 -720 | 1165 275 | -1550 394 | 1798 45 | -48 96 | -396 359 | -422 117 | 725 -369 | -1986 -294 | -1366 -249 | 439 |
| 434(A) | 1954 -149 -16 | -1836 -500 -7108 | 1733 233 -8150 | -180 43 -894 | -2714 -381 -1115 | -1429 399 -701 | -806 106 -1378 | -2438 -626 * | -679 210 * | -2518 -466 | -1698 -720 | -430 275 | 1775 394 | -448 45 | -1211 96 | -736 359 | -894 117 | -1923 -369 | -2765 -294 | -2117 -249 | 440 |

TABLE 9-continued

| | | | | | | | | | | | | | | | |
|---|---|---|---|---|---|---|---|---|---|---|---|---|---|---|---|
| 435(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 441 |
| 436(D) | -1736 -149 -16 | -3455 -500 -7108 | 3490 233 -8150 | 97 43 -894 | -3737 -381 -1115 | -1646 399 -701 | -1070 106 -1378 | -3753 -626 * | -1363 210 * | -3647 -466 | -3016 -720 | 1602 275 | -2204 394 | -760 45 | -2218 96 | -1420 359 | -1838 117 | -3213 -369 | -3756 -294 | -2780 -249 | 442 |
| 437(V) | -1721 -149 -16 | -1302 -500 -7108 | -4229 233 -8150 | -3874 43 -894 | -1705 -381 -1115 | -3894 399 -701 | -3582 106 -1378 | 1607 -626 * | -3706 210 * | -582 -466 | -513 -720 | -3610 275 | -3786 394 | -3559 45 | -3767 96 | -3209 359 | -1725 117 | 3294 -369 | -3158 -294 | -2712 -249 | 443 |
| 438(V) | 594 -149 -16 | -988 -500 -7108 | -3391 233 -8150 | -2911 43 -894 | -1164 -381 -1115 | -2888 399 -701 | -2187 106 -1378 | 845 -626 * | -2637 210 * | 765 -466 | -154 -720 | -2576 275 | -2962 394 | -2387 45 | -2622 96 | -2074 359 | -1205 117 | 2800 -369 | -2084 -294 | -1724 -249 | 444 |
| 439(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 445 |
| 440(I) | -1754 -149 -16 | -1308 -500 -7108 | -4295 233 -8150 | -3867 43 -894 | -1434 -381 -1115 | -3978 399 -701 | -3377 106 -1378 | 2661 -626 * | -3697 210 * | 862 -466 | -247 -720 | -3617 275 | -3754 394 | -3406 45 | -3679 96 | -3243 359 | -1725 117 | 2373 -369 | -2852 -294 | -2526 -249 | 446 |
| 441(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | -4056 96 | -3026 359 | -2913 117 | -3650 -369 | -3096 -294 | -3185 -249 | 447 |
| 442(Y) | -1321 -149 -16 | -1438 -500 -7108 | -1994 233 -8150 | -1608 43 -894 | 2186 -381 -1115 | 527 399 -701 | -450 106 -1378 | -1117 -626 * | -1481 210 * | -1211 -466 | -693 -720 | 1178 275 | -2522 394 | -1217 45 | -1665 96 | -1518 359 | -1275 117 | -1021 -369 | -198 -294 | 3178 -249 | 448 |
| 443(C) | -675 -149 -16 | 2205 -500 -7108 | -2544 233 -8150 | 972 43 -894 | -572 -381 -1115 | -2236 399 -701 | -1121 106 -1378 | 1373 -626 * | -1671 210 * | 679 -466 | 261 -720 | -1700 275 | -2270 394 | -1403 45 | -1668 96 | -1311 359 | -621 117 | 1601 -369 | -1150 -294 | -790 -249 | 449 |
| 444(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 450 |
| 445(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 451 |
| 446(K) | -1060 -149 -16 | -2058 -500 -7108 | -1088 233 -8150 | -460 43 -894 | -2432 -381 -1115 | -1917 399 -701 | -357 106 -1378 | -1970 -626 * | 2801 210 * | -1978 -466 | -1220 -720 | -632 275 | -1990 394 | 1339 45 | 367 96 | -999 359 | -946 117 | 536 -369 | -2145 -294 | -1717 -249 | 452 |
| 447(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 453 |
| 448(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 454 |
| 449(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 455 |
| 450(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 456 |
| 451(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 457 |

TABLE 9-continued

| | | | | | | | | | | | | | | | | | | | | | |
|---|---|---|---|---|---|---|---|---|---|---|---|---|---|---|---|---|---|---|---|---|---|
| 452(P) | −1659 | −2241 | −2022 | −1646 | −3185 | −2242 | −1373 | −3000 | −450 | −2936 | −2274 | −1624 | 3435 | −1065 | 2095 | −1730 | −1750 | −2593 | −2816 | −2613 | 458 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 453(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 459 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 454(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 460 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 455(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 461 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 456(K) | 1368 | −1491 | −763 | −332 | −2319 | −1417 | −551 | −1998 | 1786 | −2068 | −1221 | −500 | −1721 | −160 | −470 | 1631 | −587 | −1532 | −2299 | −1754 | 462 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 457(P) | −1500 | −1738 | −2514 | −2380 | −1555 | −2358 | −2022 | −1126 | −2063 | 1224 | −841 | −2189 | 3436 | −2061 | −2129 | −1822 | −1674 | −1231 | −2290 | −1878 | 463 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 458(T) | −351 | −974 | −2208 | −2185 | −2894 | −1237 | −2041 | −2561 | −2125 | −2863 | −2046 | −1539 | −1948 | −1923 | −2218 | 1543 | 3230 | −1758 | −3139 | −2834 | 464 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 459(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 465 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 460(M) | 2706 | −986 | −2433 | −2144 | −1502 | −1684 | −1706 | −700 | −1858 | −968 | 2744 | −1705 | −2188 | −1713 | −1932 | −963 | −862 | −592 | −2145 | −1794 | 466 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 461(I) | −2103 | −1659 | −4461 | −3992 | −869 | −4152 | −3233 | 3082 | −3723 | 1619 | 290 | −3801 | −3788 | −3171 | −3557 | −3432 | −2046 | 487 | −2418 | −2265 | 467 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 462(I) | −1761 | −1312 | −4317 | −3954 | −1713 | −4027 | −3703 | 3225 | −3814 | −556 | −498 | −3712 | −3859 | −3653 | −3877 | −3344 | −1754 | 2110 | −3216 | −2787 | 468 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 463(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 469 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 464(K) | 1641 | −2033 | −323 | 914 | −2415 | −1565 | −296 | −2097 | 2052 | −2080 | −1233 | −257 | −1736 | 125 | −133 | −646 | −702 | −1707 | −2258 | −1657 | 470 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 465(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 471 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 466(L) | −1699 | −1807 | −2268 | −1925 | −830 | −2795 | −1551 | −455 | −1225 | 2510 | 90 | −1958 | −2845 | 1927 | −1308 | −2067 | −1651 | −846 | −1841 | −1454 | 472 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 467(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 473 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |
| 468(D) | −853 | −2415 | 2115 | 1717 | −2702 | −1468 | −378 | −2484 | 1085 | −2417 | −1546 | −84 | −1732 | 41 | −699 | 696 | −824 | −2025 | −2594 | −1839 | 474 |
| | −149 | −500 | 233 | 43 | −381 | 399 | 106 | −626 | 210 | −466 | −720 | 275 | 394 | 45 | 96 | 359 | 117 | −369 | −294 | −249 | |
| | −16 | −7108 | −8150 | −894 | −1115 | −701 | −1378 | * | * | | | | | | | | | | | | |

TABLE 9-continued

| | | | | | | | | | | | | | | | | | | |
|---|---|---|---|---|---|---|---|---|---|---|---|---|---|---|---|---|---|---|
| 469(S) | −892 −149 −16 | −1780 −500 −7108 | −931 233 −8150 | −688 43 −894 | −2757 −381 −1115 | −1643 399 −701 | −830 106 −1378 | −2472 −626 * | 1671 210 * | −2492 −466 | −1708 −720 | −799 275 | −2018 394 | −468 45 | −365 96 | 2676 359 | −1004 117 | −1981 −369 | −2598 −294 | −2130 −249 | 475 |
| 470(C) | −1135 −149 −16 | 3503 −500 −7108 | −3700 233 −8150 | −3406 43 −894 | −1670 −381 −1115 | −2549 399 −701 | −2675 106 −1378 | 653 −626 * | −3101 210 * | −916 −466 | −667 −720 | −2727 275 | −2925 394 | −2870 45 | −3030 96 | −1868 359 | −1288 117 | 2927 −369 | −2619 −294 | −2222 −249 | 476 |
| 471(A) | 2590 −149 −16 | −1035 −500 −7108 | −2404 233 −8150 | −2530 43 −894 | −3236 −381 −1115 | 2290 399 −701 | −2365 106 −1378 | −2954 −626 * | −2627 210 * | −3240 −466 | −2389 −720 | −1719 275 | −2027 394 | −2302 45 | −2637 96 | −656 359 | −851 117 | −1991 −369 | −3423 −294 | −3234 −249 | 477 |
| 472(L) | −2632 −149 −16 | −2152 −500 −7108 | −4630 233 −8150 | −4185 43 −894 | 1767 −381 −1115 | −4324 399 −701 | −2442 106 −1378 | −61 −626 * | −3879 210 * | 2789 −466 | 563 −720 | −3833 275 | −3823 394 | −2970 45 | −3513 96 | −3609 359 | −2518 117 | −738 −369 | −1527 −294 | −945 −249 | 478 |
| 473(I) | −2073 −149 −16 | −1632 −500 −7108 | −4434 233 −8150 | −3975 43 −894 | −911 −381 −1115 | −4130 399 −701 | −3238 106 −1378 | 3164 −626 * | −3706 210 * | 1451 −466 | 244 −720 | −3779 275 | −3785 394 | −3187 45 | −3557 96 | −3413 359 | −2021 117 | 546 −369 | −2449 −294 | −2273 −249 | 479 |
| 474(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 480 |
| 475(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 481 |
| 476(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 482 |
| 477(R) | −2957 −149 −16 | −3022 −500 −7108 | −3318 233 −8150 | −2735 43 −894 | −3796 −381 −1115 | −2998 399 −701 | −1968 106 −1378 | −3912 −626 * | −846 210 * | −3631 −466 | −3157 −720 | −2611 275 | −3280 394 | −1724 45 | 4056 96 | −3026 359 | −2913 117 | −3650 −369 | −3096 −294 | −3185 −249 | 483 |
| 478(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 484 |
| 479(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 485 |
| 480(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 486 |
| 481(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 487 |
| 482(T) | −359 −149 −16 | −976 −500 −7108 | −2225 233 −8150 | −2229 43 −894 | −2900 −381 −1115 | −1242 399 −701 | −2074 106 −1378 | −2560 −626 * | −2170 210 * | −2875 −466 | −2064 −720 | −1561 275 | −1958 394 | −1969 45 | −2247 96 | 1110 359 | 3375 117 | −1760 −369 | −3152 −294 | −2850 −249 | 488 |
| 483(Y) | −3402 −149 −16 | −2632 −500 −7108 | −3941 233 −8150 | −4011 43 −894 | 1064 −381 −1115 | −3924 399 −701 | 3388 106 −1378 | −2526 −626 * | −3541 210 * | −1996 −466 | −1973 −720 | −2625 275 | −3821 394 | −2664 45 | −3170 96 | −3135 359 | −3280 117 | −2619 −369 | 3420 −294 | 3756 −249 | 489 |
| 484(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 490 |
| 485(M) | −2322 −149 −16 | −1904 −500 −7108 | −4536 233 −8150 | −3951 43 −894 | 2387 −381 −1115 | −4112 399 −701 | −2676 106 −1378 | 67 −626 * | −3649 210 * | 2034 −466 | 3156 −720 | −3710 275 | −3633 394 | −2803 45 | −3311 96 | −3309 359 | −2204 117 | −588 −369 | −1794 −294 | −1586 −249 | 491 |

TABLE 9-continued

| | | | | | | | | | | | | | | | | |
|---|---|---|---|---|---|---|---|---|---|---|---|---|---|---|---|---|
| 486(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 492 |
| 487(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 493 |
| 488(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 494 |
| 489(H) | -3205 -149 -16 | -3079 -500 -7108 | -2723 233 -8150 | -2890 43 -894 | -2110 -381 -1115 | -3046 399 -701 | 5295 106 -1378 | -4135 -626 * | -2617 210 * | -3813 -466 | -3561 -720 | -2886 275 | -3482 394 | -2833 45 | -2620 96 | -3291 359 | -3356 117 | -3895 -369 | -2397 -294 | -1681 -249 | 495 |
| 490(V) | -1754 -149 -16 | -1297 -500 -7108 | -4329 233 -8150 | -3968 43 -894 | -1770 -381 -1115 | -4053 399 -701 | -3752 106 -1378 | 2604 -626 * | -3840 210 * | -621 -466 | -545 -720 | -3728 275 | -3878 394 | -3699 45 | -3917 96 | -3370 359 | -1746 117 | 2859 -369 | -3276 -294 | -2829 -249 | 496 |
| 491(A) | 2587 -149 -16 | -828 -500 -7108 | -2477 233 -8150 | -2155 43 -894 | -1837 -381 -1115 | -1468 399 -701 | -1728 106 -1378 | -743 -626 * | -1941 210 * | -1564 -466 | -954 -720 | -1607 275 | -2033 394 | -1725 45 | -2034 96 | -738 359 | 1178 117 | 1108 -369 | -2310 -294 | -1972 -249 | 497 |
| 492(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 498 |
| 493(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 499 |
| 494(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 500 |
| 495(Y) | -866 -149 -16 | -976 -500 -7108 | -1863 233 -8150 | -3623 43 -894 | 1353 -381 -1115 | -2145 399 -701 | 1318 106 -1378 | -556 -626 * | -1116 210 * | -777 -466 | -173 -720 | -1242 275 | -2197 394 | 1714 45 | -1301 96 | -1173 359 | -802 117 | 888 -369 | -445 -294 | 2749 -249 | 501 |
| 496(D) | 417 -149 -16 | -1831 -500 -7108 | 1647 233 -8150 | 1094 43 -894 | -2065 -381 -1115 | -1488 399 -701 | -353 106 -1378 | -1618 -626 * | -107 210 * | -1820 -466 | -1019 -720 | -189 275 | -1698 394 | 30 45 | -623 96 | -603 359 | -643 117 | 1629 -369 | -2154 -294 | -1520 -249 | 502 |
| 497(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 503 |
| 498(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 504 |
| 499(T) | 492 -149 -16 | -1190 -500 -7108 | -706 233 -8150 | -181 43 -894 | -1475 -381 -1115 | 311 399 -701 | -333 106 -1378 | -1099 -626 * | -81 210 * | 71 -466 | -509 -720 | 570 275 | 1113 394 | -6 45 | -509 96 | -450 359 | 1123 117 | -835 -369 | -1680 -294 | -1161 -249 | 505 |
| 500(I) | -2091 -149 -16 | -1746 -500 -7108 | -3971 233 -8150 | -3840 43 -894 | -1676 -381 -1115 | -3532 399 -701 | -3289 106 -1378 | 3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 506 |
| 501(A) | 3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 507 |
| 502(L) | -2239 -149 -16 | -1892 -500 -7108 | -3711 233 -8150 | -3400 43 -894 | 301 -381 -1115 | -3520 399 -701 | -1210 106 -1378 | -542 -626 * | -2948 210 * | 2564 -466 | -35 -720 | -2786 275 | -3395 394 | -2438 45 | -2750 96 | -2747 359 | -2165 117 | -945 -369 | -573 -294 | 2562 -249 | 508 |

TABLE 9-continued

| | | | | | | | | | | | | | | | | | | | |
|---|---|---|---|---|---|---|---|---|---|---|---|---|---|---|---|---|---|---|---|
| 503(V) | −1757 −149 −16 | −1387 −500 −7108 | −4101 233 −8150 | −3681 43 −894 | −1174 −381 −1115 | −3714 399 −701 | −3031 106 −1378 | 880 −626 * | −3410 210 * | 1254 −466 | −60 −720 | −3407 275 | −3585 394 | −3094 45 | −3354 96 | −2984 359 | −1743 117 | 3014 −369 | −2536 −294 | −2219 −249 | 509 |
| 504(Q) | −982 −149 −16 | −2251 −500 −7108 | −866 233 −8150 | 971 43 −894 | −2711 −381 −1115 | −1822 399 −701 | −252 106 −1378 | −2340 −626 * | 1444 210 * | −2194 −466 | −1356 −720 | −464 275 | −1885 394 | 2646 45 | 1632 96 | −858 359 | −863 117 | −1958 −369 | −2245 −294 | −1765 −249 | 510 |
| 505(E) | −1162 −149 −16 | −2771 −500 −7108 | 2137 233 −8150 | 2239 43 −894 | −3046 −381 −1115 | −1526 399 −701 | −626 106 −1378 | −2849 −626 * | −546 210 * | −2792 −466 | −1983 −720 | −145 275 | −1905 394 | −242 45 | −1192 96 | −940 359 | 1396 117 | −2385 −369 | −2990 −294 | −2169 −249 | 511 |
| 506(G) | −1707 −149 −16 | −2684 −500 −7108 | 1591 233 −8150 | −614 43 −894 | −3783 −381 −1115 | 3190 399 −701 | −1613 106 −1378 | −3795 −626 * | −1887 210 * | −3775 −466 | −3119 −720 | −915 275 | −2456 394 | −1358 45 | −2539 96 | −1610 359 | −1924 117 | −3150 −369 | −3636 −294 | −3124 −249 | 512 |
| 507(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 513 |
| 508(M) | −473 −149 −16 | −522 −500 −7108 | −1819 233 −8150 | −1236 43 −894 | −468 −381 −1115 | −1879 399 −701 | −687 106 −1378 | 1519 −626 * | −996 210 * | 566 −466 | 1677 −720 | −1154 275 | −1937 394 | 836 45 | −1131 96 | 1079 359 | −413 117 | 102 −369 | −957 −294 | −585 −249 | 514 |
| 509(I) | −1761 −149 −16 | −1312 −500 −7108 | −4317 233 −8150 | −3954 43 −894 | −1713 −381 −1115 | −4027 399 −701 | −3703 106 −1378 | 3225 −626 * | −3814 210 * | −556 −466 | −498 −720 | −3712 275 | −3859 394 | −3653 45 | −3877 96 | −3344 359 | −1754 117 | 2110 −369 | −3216 −294 | −2787 −249 | 515 |
| 510(T) | 782 −149 −16 | −1467 −500 −7108 | −550 233 −8150 | 1029 43 −894 | −2202 −381 −1115 | −1425 399 −701 | −709 106 −1378 | −1791 −626 * | −472 210 * | −1993 −466 | −1203 −720 | −528 275 | −1787 394 | −368 45 | −902 96 | −617 359 | 2685 117 | −1400 −369 | −2333 −294 | −1783 −249 | 516 |
| 511(I) | −1766 −149 −16 | −1333 −500 −7108 | −4283 233 −8150 | −3923 43 −894 | −1635 −381 −1115 | −3967 399 −701 | −3619 106 −1378 | 3388 −626 * | −3759 210 * | −473 −466 | −437 −720 | −3672 275 | −3822 394 | −3576 45 | −3804 96 | −3285 359 | −1764 117 | 1695 −369 | −3126 −294 | −2717 −249 | 517 |
| 512(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 518 |
| 513(A) | 2705 −149 −16 | −1451 −500 −7108 | −1036 233 −8150 | −913 43 −894 | −2506 −381 −1115 | −1504 399 −701 | −1143 106 −1378 | −2174 −626 * | −794 210 * | −2337 −466 | −1613 −720 | −946 275 | −1993 394 | 2040 45 | −1061 96 | −809 359 | −910 117 | −1703 −369 | −2633 −294 | −2156 −249 | 519 |
| 514(H) | −615 −149 −16 | −1680 −500 −7108 | 1444 233 −8150 | 66 43 −894 | −1883 −381 −1115 | 168 399 −701 | 2650 106 −1378 | −1558 −626 * | −86 210 * | −1691 −466 | −891 −720 | −223 275 | −1680 394 | 31 45 | −577 96 | −571 359 | −585 117 | 1267 −369 | −2007 −294 | −1397 −249 | 520 |
| 515(K) | −654 −149 −16 | −2006 −500 −7108 | −546 233 −8150 | 42 43 −894 | −2376 −381 −1115 | −1581 399 −701 | −133 106 −1378 | −2066 −626 * | 1935 210 * | −1987 −466 | −1107 −720 | 1132 275 | −1658 394 | 1043 45 | 1058 96 | −540 359 | 1180 117 | −1660 −369 | −2113 −294 | −1532 −249 | 521 |
| 516(N) | −933 −149 −16 | −2085 −500 −7108 | −946 233 −8150 | −284 43 −894 | −2472 −381 −1115 | −1822 399 −701 | −253 106 −1378 | −2090 −626 * | 1711 210 * | 76 −466 | −1204 −720 | 1918 275 | −1876 394 | 175 45 | 1799 96 | −841 359 | −817 117 | −1755 −369 | −2132 −294 | −1663 −249 | 522 |
| 517(E) | −416 −149 −16 | −987 −500 −7108 | −843 233 −8150 | 1107 43 −894 | −1070 −381 −1115 | −1583 399 −701 | −338 106 −1378 | −623 −626 * | −183 210 * | 879 −466 | −172 −720 | −489 275 | −1679 394 | −94 45 | −565 96 | 544 359 | 813 117 | 265 −369 | −1379 −294 | −905 −249 | 523 |
| 518(I) | −2258 −149 −16 | −1804 −500 −7108 | −4588 233 −8150 | −4084 43 −894 | −706 −381 −1115 | −4269 399 −701 | −3231 106 −1378 | 2527 −626 * | −3807 210 * | 2292 −466 | 465 −720 | −3923 275 | −3814 394 | −3118 45 | −3570 96 | −3544 359 | −2181 117 | 190 −369 | −2303 −294 | −2237 −249 | 524 |
| 519(Q) | −477 −149 −16 | −1909 −500 −7108 | 958 233 −8150 | 282 43 −894 | −2211 −381 −1115 | −1389 399 −701 | 1484 106 −1378 | −1953 −626 * | 285 210 * | −1921 −466 | −1018 −720 | −32 275 | −1517 394 | 2318 45 | −225 96 | 630 359 | 559 117 | −1525 −369 | −2110 −294 | −1430 −249 | 525 |

TABLE 9-continued

| | | | | | | | | | | | | | | | | | | |
|---|---|---|---|---|---|---|---|---|---|---|---|---|---|---|---|---|---|---|
| 520(L) | −2127<br>−149<br>−16 | −1743<br>−500<br>−7108 | −4402<br>233<br>−8150 | −3796<br>−894<br>43 | 1257<br>−381<br>−1115 | −3918<br>399<br>−701 | −2674<br>106<br>−1378 | 149<br>−626<br>* | −3492<br>210<br>* | 2527<br>−466 | 2164<br>−720 | −3553<br>275 | −3509<br>394 | −2714<br>45 | −3181<br>96 | −3095<br>359 | −2019<br>117 | 570<br>−369 | −1870<br>−294 | −1818<br>−249 | 526 |
| 521(N) | −723<br>−149<br>−16 | −2217<br>−500<br>−7108 | 958<br>233<br>−8150 | 236<br>−894<br>43 | −2518<br>−381<br>−1115 | −1466<br>399<br>−701 | 1611<br>106<br>−1378 | −2279<br>−626<br>* | 1719<br>210<br>* | −2217<br>−466 | −1334<br>−720 | 2285<br>275 | −1666<br>394 | 166<br>45 | −401<br>96 | −570<br>359 | −677<br>117 | −1837<br>−369 | −2382<br>−294 | −1678<br>−249 | 527 |
| 522(V) | −1754<br>−149<br>−16 | −1297<br>−500<br>−7108 | −4330<br>233<br>−8150 | −3968<br>−894<br>43 | −1770<br>−381<br>−1115 | −4053<br>399<br>−701 | −3752<br>106<br>−1378 | 2623<br>−626<br>* | −3841<br>210<br>* | −620<br>−466 | −545<br>−720 | −3729<br>275 | −3878<br>394 | −3699<br>45 | −3918<br>96 | −3371<br>359 | −1746<br>117 | 2846<br>−369 | −3277<br>−294 | −2830<br>−249 | 528 |
| 523(S) | 1545<br>−149<br>−16 | −974<br>−500<br>−7108 | −2003<br>233<br>−8150 | −1825<br>−894<br>43 | −2867<br>−381<br>−1115 | −1206<br>399<br>−701 | −1790<br>106<br>−1378 | −2580<br>−626<br>* | −1788<br>210<br>* | −2795<br>−466 | −1932<br>−720 | −1362<br>275 | 1826<br>394 | −1586<br>45 | −1999<br>96 | 2362<br>359 | −672<br>117 | −1755<br>−369 | −3057<br>−294 | −2721<br>−249 | 529 |
| 524(D) | −1776<br>−149<br>−16 | −3649<br>−500<br>−7108 | 3326<br>233<br>−8150 | 1869<br>−894<br>43 | −3838<br>−381<br>−1115 | −1642<br>399<br>−701 | −1031<br>106<br>−1378 | −3788<br>−626<br>* | −1322<br>210<br>* | −3660<br>−466 | −3029<br>−720 | −245<br>275 | −2192<br>394 | −711<br>45 | −2201<br>96 | −1425<br>359 | −1855<br>117 | −3264<br>−369 | −3821<br>−294 | −2816<br>−249 | 530 |
| 525(E) | 423<br>−149<br>−16 | −2950<br>−500<br>−7108 | 1944<br>233<br>−8150 | 2696<br>−894<br>43 | −3223<br>−381<br>−1115 | −1545<br>399<br>−701 | −718<br>106<br>−1378 | −3047<br>−626<br>* | −715<br>210<br>* | −2979<br>−466 | −2196<br>−720 | −161<br>275 | −1968<br>394 | −347<br>45 | −1403<br>96 | −1043<br>359 | −1314<br>117 | −2569<br>−369 | −3177<br>−294 | −2316<br>−249 | 531 |
| 526(E) | −2641<br>−149<br>−16 | −3308<br>−500<br>−7108 | −896<br>233<br>−8150 | 3732<br>−894<br>43 | −3966<br>−381<br>−1115 | −2458<br>399<br>−701 | −2043<br>106<br>−1378 | −4105<br>−626<br>* | −2128<br>210<br>* | −4016<br>−466 | −3555<br>−720 | −1531<br>275 | −2959<br>394 | −1842<br>45 | −2560<br>96 | −2479<br>359 | −2750<br>117 | −3722<br>−369 | −3563<br>−294 | −3385<br>−249 | 532 |
| 527(L) | −2339<br>−149<br>−16 | −1899<br>−500<br>−7108 | −4618<br>233<br>−8150 | −4042<br>−894<br>43 | 1570<br>−381<br>−1115 | −4204<br>399<br>−701 | −2849<br>106<br>−1378 | 1440<br>−626<br>* | −3758<br>210<br>* | 2558<br>−466 | 676<br>−720 | −3825<br>275 | −3700<br>394 | −2902<br>45 | −3418<br>96 | −3418<br>359 | −2226<br>117 | −382<br>−369 | −1924<br>−294 | −1778<br>−249 | 533 |
| 528(A) | 2338<br>−149<br>−16 | −1990<br>−500<br>−7108 | −241<br>233<br>−8150 | 938<br>−894<br>43 | −2395<br>−381<br>−1115 | −1557<br>399<br>−701 | −423<br>106<br>−1378 | −2061<br>−626<br>* | 954<br>210<br>* | −2103<br>−466 | −1286<br>−720 | −301<br>275 | −1791<br>394 | −26<br>45 | −375<br>96 | −717<br>359 | −784<br>117 | −1691<br>−369 | −2330<br>−294 | −1728<br>−249 | 534 |
| 529(R) | 524<br>−149<br>−16 | −2098<br>−500<br>−7108 | −789<br>233<br>−8150 | −146<br>−894<br>43 | −2504<br>−381<br>−1115 | −1729<br>399<br>−701 | 1632<br>106<br>−1378 | −2153<br>−626<br>* | 1229<br>210<br>* | −2054<br>−466 | −1204<br>−720 | −379<br>275 | −1789<br>394 | 1328<br>45 | 2313<br>96 | −719<br>359 | −724<br>117 | −1774<br>−369 | −2150<br>−294 | −1637<br>−249 | 535 |
| 530(R) | −2957<br>−149<br>−16 | −3022<br>−500<br>−7108 | −3318<br>233<br>−8150 | −2735<br>−894<br>43 | −3796<br>−381<br>−1115 | −2998<br>399<br>−701 | −1968<br>106<br>−1378 | −3912<br>−626<br>* | −846<br>210<br>* | −3631<br>−466 | −3157<br>−720 | −2611<br>275 | −3280<br>394 | −1724<br>45 | 4056<br>96 | −3026<br>359 | −2913<br>117 | −3650<br>−369 | −3096<br>−294 | −3185<br>−249 | 536 |
| 531(R) | −1895<br>−149<br>−16 | −2713<br>−500<br>−7108 | −2327<br>233<br>−8150 | −1192<br>−894<br>43 | −3484<br>−381<br>−1115 | −2502<br>399<br>−701 | −481<br>106<br>−1378 | −2856<br>−626<br>* | 2144<br>210<br>* | −2544<br>−466 | −1842<br>−720 | −1161<br>275 | −2458<br>394 | 1393<br>45 | 3023<br>96 | −1770<br>359 | −1619<br>117 | −2599<br>−369 | −2421<br>−294 | −2259<br>−249 | 537 |
| 532(A) | 2935<br>−149<br>−16 | −1714<br>−500<br>−7108 | −553<br>233<br>−8150 | 857<br>−894<br>43 | −2769<br>−381<br>−1115 | −1546<br>399<br>−701 | −1218<br>106<br>−1378 | −2333<br>−626<br>* | −1106<br>210<br>* | −2591<br>−466 | −1873<br>−720 | −809<br>275 | −2065<br>394 | −934<br>45 | −1502<br>96 | −954<br>359 | −1103<br>117 | −1872<br>−369 | −2898<br>−294 | −2374<br>−249 | 538 |
| 533(A) | 1291<br>−149<br>−16 | −1874<br>−500<br>−7108 | −176<br>233<br>−8150 | 1227<br>−894<br>43 | −2177<br>−381<br>−1115 | −1392<br>399<br>−701 | −109<br>106<br>−1378 | −1909<br>−626<br>* | 277<br>210<br>* | −1891<br>−466 | −995<br>−720 | 1134<br>275 | −1522<br>394 | 1248<br>45 | −228<br>96 | −361<br>359 | 562<br>117 | −1492<br>−369 | −2090<br>−294 | −1419<br>−249 | 539 |
| 534(W) | −805<br>−149<br>−16 | −687<br>−500<br>−7108 | −2581<br>233<br>−8150 | −2028<br>−894<br>43 | 138<br>−381<br>−1115 | −2236<br>399<br>−701 | −697<br>106<br>−1378 | 897<br>−626<br>* | −1681<br>210<br>* | 421<br>−466 | 141<br>−720 | −1645<br>275 | −2282<br>394 | −1369<br>45 | −1627<br>96 | −1315<br>359 | 636<br>117 | −90<br>−369 | 4479<br>−294 | 1809<br>−249 | 540 |
| 535(H) | −408<br>−149<br>−16 | −1801<br>−500<br>−7108 | −274<br>233<br>−8150 | 1284<br>−894<br>43 | −2096<br>−381<br>−1115 | −1385<br>399<br>−701 | 1500<br>106<br>−1378 | −1822<br>−626<br>* | 1168<br>210<br>* | −1802<br>−466 | −899<br>−720 | −33<br>275 | −1479<br>394 | 1381<br>45 | −102<br>96 | −303<br>359 | 595<br>117 | 221<br>−369 | −1996<br>−294 | −1339<br>−249 | 541 |

TABLE 9-continued

| | | | | | | | | | | | | | | | | | | | |
|---|---|---|---|---|---|---|---|---|---|---|---|---|---|---|---|---|---|---|---|
| 536(Q) | −650 −149 −16 | −1737 −500 −7108 | −627 233 −8150 | −72 43 −894 | −1981 −381 −1115 | −1615 399 −701 | −209 106 −1378 | −1625 −626 * | 1223 210 | 392 −466 | −866 −720 | −318 275 | 1222 394 | 2120 45 | 50 96 | −598 359 | −572 117 | −1326 −369 | −1932 −294 | −1394 −249 | 542 |
| 537(P) | −2931 −324 −16 | −2878 −500 −7108 | −3420 233 −8150 | −3706 43 −894 | −4181 −381 −1115 | −2925 399 −701 | −3468 106 −1378 | −4621 −626 * | −3859 210 | −4490 −466 | −4165 −720 | −3491 275 | 4225 394 | −3781 45 | −3695 96 | −3182 359 | −3279 117 | −4087 −369 | −3594 −294 | −4064 −249 | 543 |
| 538(A) | 2195 −149 −16 | −924 −500 −7108 | −2368 233 −8150 | −546 43 −894 | −1397 −381 −1115 | −1356 399 −701 | −583 106 −1378 | −812 −626 * | −365 210 | −1167 −466 | −487 −720 | −618 275 | −1660 394 | 1324 45 | −684 96 | −483 359 | −404 117 | 462 −369 | −1703 −294 | −1242 −249 | 544 |
| 539(P) | 411 −149 −19 | −1017 −500 −6804 | −1886 233 −7846 | −1616 43 −894 | −1600 −381 −1115 | −1588 399 −428 | −1411 106 −1961 | −962 −626 * | −1408 210 | 495 −466 | −755 −720 | −1384 275 | 3156 394 | −1323 45 | −1577 96 | −847 359 | −785 117 | −783 −369 | −2111 −294 | −1716 −249 | 545 |
| 540(R) | −1612 −149 −16 | −2397 −500 −7108 | −2037 233 −8150 | −1033 43 −894 | −2897 −381 −1115 | −2352 399 −701 | −458 106 −1378 | −2365 −626 * | 2184 210 | 665 −466 | −1520 −720 | −1051 275 | −2334 394 | −51 45 | 2602 96 | −1545 359 | −1395 117 | −2143 −369 | −2262 −294 | −2014 −249 | 546 |
| 541(Y) | 712 −149 −16 | −796 −500 −7108 | −2334 233 −8150 | −1883 43 −894 | −370 −381 −1115 | −2028 399 −701 | −986 106 −1378 | −143 −626 * | −1607 210 | −663 −466 | −131 −720 | −1587 275 | −2243 394 | −1383 45 | −1656 96 | −1178 359 | −771 117 | 1114 −369 | −965 −294 | 3479 −249 | 547 |
| 542(T) | −527 −149 −16 | −1669 −500 −7108 | 1091 233 −8150 | −27 43 −894 | −2315 −381 −1115 | −1379 399 −701 | −443 106 −1378 | −2033 −626 * | −151 210 | −2081 −466 | −1218 −720 | −282 275 | 557 394 | −41 45 | −650 96 | 1128 359 | 2077 117 | −1576 −369 | −2321 −294 | −1690 −249 | 548 |
| 543(R) | −2957 −149 −16 | −3022 −500 −7108 | −3318 233 −8150 | −2735 43 −894 | −3796 −381 −1115 | −2998 399 −701 | −1968 106 −1378 | −3912 −626 * | −846 210 | −3631 −466 | −3157 −720 | −2611 275 | −3280 394 | −1724 45 | 4056 96 | −3026 359 | −2913 117 | −3650 −369 | −3096 −294 | −3185 −249 | 549 |
| 544(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 | −4671 −466 | −4212 −720 | −3320 275 | −3352 394 | −3748 45 | −3779 96 | −2839 359 | −2981 117 | −4004 −369 | −3668 −294 | −4222 −249 | 550 |
| 545(V) | −1747 −149 −16 | −1296 −500 −7108 | −4310 233 −8150 | −3948 43 −894 | −1758 −381 −1115 | −4023 399 −701 | −3716 106 −1378 | 2215 −626 * | −3813 210 | −615 −466 | −540 −720 | −3705 275 | −3860 394 | −3670 45 | −3887 96 | −3339 359 | −1741 117 | 3087 −369 | −3252 −294 | −2806 −249 | 551 |
| 546(L) | −2871 −149 −16 | −2457 −500 −7108 | 4231 233 −8150 | −4103 43 −894 | −1033 −381 −1115 | −3803 399 −701 | −3165 106 −1378 | −541 −626 * | −3734 210 | 3130 −466 | −31 −720 | −3935 275 | −3797 394 | −3286 45 | −3484 96 | −3713 359 | −2869 117 | −1136 −369 | −2394 −294 | −2220 −249 | 552 |
| 547(A) | 2404 −149 −16 | −890 −500 −7108 | −1926 233 −8150 | −1629 43 −894 | −1803 −381 −1115 | 1275 399 −701 | −1415 106 −1378 | −1282 −626 * | −1490 210 | 392 −466 | −963 −720 | −1316 275 | −1930 394 | −1328 45 | −1674 96 | −654 359 | −644 117 | −952 −369 | −2187 −294 | −1810 −249 | 553 |
| 548(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 | −3387 −466 | −2839 −720 | −2048 275 | −3039 394 | −1260 45 | −465 96 | −2604 359 | −2536 117 | −3331 −369 | −3001 −294 | −2988 −249 | 554 |
| 549(Y) | −3621 −149 −16 | −2707 −500 −7108 | −4176 233 −8150 | −4424 43 −894 | 2950 −381 −1115 | −4049 399 −701 | −394 106 −1378 | −2539 −626 * | −4002 210 | −1942 −466 | −1987 −720 | −2749 275 | −3933 394 | −2854 45 | −3451 96 | −3299 359 | −3499 117 | −2690 −369 | 349 −294 | 4094 −249 | 555 |
| 550(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 | −3257 −466 | −2662 −720 | −2236 275 | −2447 394 | −2798 45 | −2944 96 | −1216 359 | −1387 117 | −2183 −369 | −3405 −294 | −3320 −249 | 556 |
| 551(H) | −1741 −149 −16 | −2627 −500 −7108 | −2070 233 −8150 | −1046 43 −894 | −3303 −381 −1115 | −2401 399 −701 | 2713 106 −1378 | −2751 −626 * | 2478 210 | −2476 −466 | −1755 −720 | −1061 275 | −2375 394 | −27 45 | 2379 96 | −1621 359 | −1497 117 | −2477 −369 | −2379 −294 | −2161 −249 | 557 |

TABLE 9-continued

| | | | | | | | | | | | | | | | | | | |
|---|---|---|---|---|---|---|---|---|---|---|---|---|---|---|---|---|---|---|
| 552(L) | -1014 -149 -16 | -876 -500 -7108 | -2956 233 -8150 | -2408 43 -894 | -582 -381 -1115 | -2550 399 -701 | -1529 106 -1378 | 1721 -626 * | -2079 210 * | 2042 -466 | 345 -720 | -2114 275 | -2581 394 | -1775 45 | -2028 96 | 454 359 | -980 117 | 286 -369 | -1414 -294 | -1096 -249 | 558 |
| 553(V) | 933 -149 -16 | -842 -500 -7108 | -2818 233 -8150 | -2467 43 -894 | -1542 -381 -1115 | -1870 399 -701 | -1890 106 -1378 | 154 -626 * | -2226 210 * | -1095 -466 | -617 -720 | -1932 275 | -2326 394 | -1995 45 | -2259 96 | -1126 359 | 1070 117 | 2769 -369 | -2180 -294 | -1826 -249 | 559 |
| 554(S) | -787 -149 -16 | -1522 -500 -7108 | -1486 233 -8150 | -1172 43 -894 | -2714 -381 -1115 | -1599 399 -701 | -1112 106 -1378 | -2500 -626 * | -433 210 * | -2563 -466 | -1791 -720 | -1110 275 | -2067 394 | -796 45 | 1351 96 | 2916 359 | -989 117 | -1943 -369 | -2648 -294 | -2234 -249 | 560 |
| 555(S) | -326 -149 -16 | -1010 -500 -7108 | -1779 233 -8150 | -1541 43 -894 | -2691 -381 -1115 | -1234 399 -701 | -1566 106 -1378 | -2386 -626 * | -1486 210 * | -2594 -466 | -1749 -720 | -1228 275 | 1196 394 | -1330 45 | -1747 96 | 2396 359 | 1967 117 | -1662 -369 | -2876 -294 | -2496 -249 | 561 |
| 556(A) | 3121 -149 -16 | -934 -500 -7108 | -2489 233 -8150 | -2561 43 -894 | -3081 -381 -1115 | -1203 399 -701 | -2295 106 -1378 | -2766 -626 * | -2533 210 * | -3080 -466 | -2234 -720 | -1669 275 | -1953 394 | -2234 45 | -2533 96 | 936 359 | -746 117 | -1844 -369 | -3331 -294 | -3090 -249 | 562 |
| 557(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 563 |
| 558(R) | -586 -149 -16 | -1873 -500 -7108 | -516 233 -8150 | 979 43 -894 | -2188 -381 -1115 | -1543 399 -701 | -123 106 -1378 | -1869 -626 * | 1290 210 * | -353 -466 | -980 -720 | -202 275 | -1622 394 | 314 45 | 1886 96 | -491 359 | 782 117 | -1495 -369 | -2024 -294 | -1439 -249 | 564 |
| 559(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 565 |
| 560(C) | 2804 -149 -16 | 3772 -500 -7108 | -3185 233 -8150 | -3198 43 -894 | -2739 -381 -1115 | -1303 399 -701 | -2462 106 -1378 | -2065 -626 * | -2882 210 * | -2628 -466 | -1924 -720 | -1927 275 | -2044 394 | -2547 45 | -2727 96 | -661 359 | -799 117 | -1463 -369 | -3099 -294 | -2886 -249 | 566 |
| 561(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 567 |
| 562(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 568 |
| 563(D) | -2784 -149 -16 | -3432 -500 -7108 | 4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 569 |
| 564(F) | -525 -21 * | -445 -6715 * | -2202 -7757 * | -1627 -894 * | 1946 -1115 * | -2001 -701 * | -744 -1378 * | 1247 -626 * | -1346 * 0 | 952 * | 561 * | 1079 * | -2030 * | -1067 * | -1362 * | -1067 * | -465 * | 338 * | -714 * | -230 * | 570 |

SEQUENCE LISTING (193 sequences)

SEQ ID NO: 1 - DNA, 2340 bp, Saccharomyces cerevisiae
atggtttacactccatccaagggtccaagaactctttacgataaggtttttgatgcacatgttgtccatcaagatgaaaatggttcctttttgttgtatatcgacagacacttggttcatgaagtcacctctccacaagctttcgaaggcctagaaaatgccggcagaaaggtcagaagagttgattgtactctagctactgtagatcataatattccaactgaatcaagaaagaatttcaaatcactagacacatttatcaagcaaactgattcgcgtttacaagtcaaaactttagagaataatgttaaacagttcggcgttccatatttcggtatgagtgatgccagacaaggtatcgtccacaccatcggtcccgaagaaggtttcactttaccaggtaccactgttgtttgtggtgactctcatacctctactcacggtgcctttggttcgctggcctttggtattggtacttctgaagttgaacacgtcttggccactcaaacaattatccaagctaaatcgaaaaacatgagaattactgttaatggtaagctatcacctggtatcacatctaaagatttgattttgtatattattggtctgataggtactgcaggtggtactggttgcgttattgaattcgcaggtgaagccattgaagctctttctatggaagcacgtatgtccatgtgtaacatggccatcgaagctggtgcaagagcaggtatgattaaaccagacgaaactactttccaatacaccaaaggcagacctttggctccaaaaggtgccgaatgggaaaaggctgttgcctactggaaaactttgaaaacagacgaaggtgccaaatttgaccacgaaatcaacattgaagctgtcgacgtgattccaactattacatggggtacttctcctcaagatgccttaccaattactggttccgtaccagatccaaaaaatgttacagacccaataaagaaatctggtatggaaagagccttagcctatatgggtttggaacctaacacaccgctaaagagcatcaaagtagataaagtctttattggatcttgtaccaatggccgtattgaagatttaagaagtgctgcagctgtagttaggggtcaaaaattggctagtaacatcaaattagctatggttgttccgggatctggtttggtcaaaaaacaagccgaagcagaaggtttggacaagattttccaagaagctggttttgaatggagagaagctggttgttcaatatgtttaggtatgaaccctgatattttggatgcctatgaacgttgtgcttctacttccaacagaaatttcgaaggtcgtcaaggtgccttgtctcgtacacatctaatgtccccagccatggcggctgctgcaggtatcgcaggtcacttcgtagatattagagaattcgaatataaggatcaagaccaaagtagtccaaaggttgaggtcacttccgaagatgaaaaagagcttgaaagtgctgcttacgatcacgctgaacctgtccaacccgaagacgctccccaagatattgccaatgatgaattaaaagatattccagtgaagtcagatgatacacctgctaaacctagctcttccggcatgaagccatttttgactttggaaggtattagcgcaccattagataaggccaatgttgatacagacgctattatcccaaagcaatttttaaagacaattaagagaacgggtttgaaaaaagggttgttttatgaatggcgtttccgtaaagacgatcaaggtaaggatcaagaaaccgattttgtattaaatgttgaaccttggagggaagctgaaatattggttgttactggtgacaatttcggatgtggttcttccagagaacacgcaccatgggctctaaaagactttggtataaaatccatcattgcaccttcttacggtgatattttctacaacaactctttcaagaacggcttattacctattagattggatcaacaaataatcattgacaaattgatccctattgctaataagggtggtaagctctgcgtcgatttaccaaatcaaaaaattttggattccgatggcaatgtgctcgttgatcattttgaaatagaacctttcagaaagcactgcctagttaacggtcttgatgatattggtattacattgcaaaaggaagaatacatttccagatacgaagctttgagaagagagaaatactcattcttggaaggtggatcaaaattattaaaatttgacaacgttccaaaaagaaaagctgttacaactactttcgataaagtccaccaggattggtag

SEQ ID NO: 2 - protein, 779 aa, Saccharomyces cerevisiae
MVYTPSKGPRTLYDKVFDAHVVHQDENGSFLLYIDRHLVHEVTSPQAFEGLENAGRKVRRVDCTLATVDHNIPTESRKNFKSLDTFIKQTDSRLQVKTLENNVKQFGVPYFGMSDARQGIVHTIGPEEGFTLPGTTVVCGDSHTSTHGAFGSLAFGIGTSEVEHVLATQTIIQAKSKNMRITVNGKLSPGITSKDLILYIIGLIGTAGGTGCVIEFAGEAIEALSMEARMSMCNMAIEAGARAGMIKPDETTFQYTKGRPLAPKGAEWEKAVAYWKTLKTDEGAKFDHEINIEAVDVIPTITWGTSPQDALPITGSVPDPKNVTDPIKKSGMERALAYMGLEPNTPLKSIKVDKVFIGSCTNGRIEDLRSAAAVVRGQKLASNIKLAMVVPGSGLVKKQAEAEGLDKIFQEAGFEWREAGCSICLGMNPDILDAYERCASTSNRNFEGRQGALSRTHLMSPAMAAAAGIAGHFVDIREFEYKDQDQSSPKVEVTSEDEKELESAAYDHAEPVQPEDAPQDIANDELKDIPVKSDDTPAKPSSSGMKPFLTLEGISAPLDKANVDTDAIIPKQFLKTIKRTGLKKGLFYEWRFRKDDQGKDQETDFVLNVEPWREAEILVVTGDNFGCGSSREHAPWALKDFGIKSIIAPSYGDIFYNNSFKNGLLPIRLDQQIIIDKLIPIANKGGKLCVDLPNQKILDSDGNVLVDHFEIEPFRKHCLVNGLDDIGITLQKEEYISRYEALRREKYSFLEGGSKLLKFDNVPKRKAVTTTFDKVHQDW

SEQ ID NO: 3 - DNA, 1116 bp, Schizosaccharomyces pombe
atgtgtgcaaagaaaatcgtcgtcttaccaggagaccatattggccctgaaattgttgcttctgccttggaggttttgaaagtcgttgagaagaagcgacctgagttaaaactcgagtttgaagaacacaagattggaggtgcctctattgatgcctatggaacccctttgactgacgagactgtgaaggcttgtttggaagctgacggtgttcttttgggtgccgttggtggtcctgaatggaccaaccccaattgtcgtcctgagcaaggtttattgaagcttcgtaagagtatgggtgtttgggccaaccttcgaccttgcaactttgccagcaagtctttagtcaagtacagccctttgaagcctgaaatcgttgaaggtgtcgatttttgtgttgtacgagaacttactggaggttgttactttggtgagcgcactgaggacaacggatcgggttatgctatggacacttggccttacagtttggaagaagtttctcgtattgctcgtttggctgcttggttagctgaaacttccaaccctcctgctcccgtcacattactcgacaaagctaatgttttggcaacttctcgtctttggcgcaagactgtagctaagatttttaaggaggaatatcctcaccttaccttaaaaaaccagctcattgactccgcagccatgcttttggtcaagagccctcgtacacttaacggtgttgttttgactgacaacttgtttggtgacattatttcagatgaggcttctgtcattcctggtagcttgggccttttgccttctgcctccctttccggtgtggtaggaaaatcagaagaaaaggttcattgtttggttgagcccattcacggtagcgctcccgatatcgctggcaagggcattgttaatcctgttggtacaattttatctgcttcccttctccttcgttatggtttgaatgctcctaaggaggctgaagctatcgaagccgccgtacgcaaggtcttggatgatacttcaattggtggacgtggtctttatactcgcgatttgggaggtgaggcttctaccgctgatattactaaggctgttgttgaagaacttgaaaaaattttgtaa

SEQ ID NO: 4 - protein, 371 aa, Schizosaccharomyces pombe
MCAKKIVVLPGDHIGPEIVASALEVLKVVEKKRPELKLEFEEHKIGGASIDAYGTPLTDETVKACLEADGVLLGAVGGPEWTNPNCRPEQGLLKLRKSMGVWANLRPCNFASKSLVKYSPLKPEIVEGVDFCVVRELTGGCYFGERTEDNGSGYAMDTWPYSLEEVSRIARLAAWLAETSNPPAPVTLLDKANVLATSRLWRKTVAKIFKEEYPHLTLKNQLIDSAAMLLVKSPRTLNGVVLTDNLFGDIISDEASVIPGSLGLLPSASLSGVVGKSEEKVHCLVEPIHGSAPDIAGKGIVNPVGTILSASLLLRYGLNAPKEAEAIEAAVRKVLDDTSIGGRGLYTRDLGGEASTADITKAVVEELEKIL

SEQ ID NO: 5 - DNA, 2355 bp, Candida galbrata
atggttactacagagactaaaggtcctaggaccctatatgataaagtatttgatgcgcatgtggtgcacaaggatgagaatggctcttacttgttgtacattgacagacatctagtgcacgaggttacttctccacaggcctttgaaggtttgactaatgcgaacagaccagtaagaagggtggattgtactttggccacagttgaccacaacatcccaaccgagtccagaaagagtttcaagaacttggactctttcattacacaaaccgactcccgcttacaagtgaagactttggaacagaacgtcaagcaatttggcgtaccatactttggtctaaccgagaagagacaaggtatcgtccatactattggtcctgagcaaggtttcaccttacctggtaccactgtggtgtgtggtgactcccacacttctactcacggtgcattcggtgcattggcattcggtatcggtacctccgaagtcgaacacgtcttggctacccaaactatcattcaaagtaaatccaagaatatgagaattagagtcgacggtaagttaagcccaggtattacatctaaggatttgattcttcatatcattggtgtgatcggtactgctggtggtactggttccgtcattgaatttgctggtgaagctatagagaacttatctatggaagctcgtatgtctatgtgtaatatgtccattgaggccggtgcaagagctggtatgatcaaaccagacaatgtcactttcgaatatttcaaaggaagaccattggccccaactggtgccgaatgggacaaggctgttgcttactggaagactttgcattctgatgagggcgccaaattcgatcacgaaatcgtcatcaaaggttcagaaattattccaactattacctggggtacttctccacaagatgcgctaccaatcagtgcatcagttccagatccagctaatgtagatgatccaatcaagaagtccggtatggagagagctctcgaatacatgggcttgaaaccaaacactccattgaagagtatctatgtcgacaaggtcttcattggttcatgtactaatggccgtattgaagatttgagaaatgccgctaaggtcttaaatggtcataagattgccccaaatatcaagagagctatggttgtcccaggatccggtttagtcaaggtacaagccgaagaagaagggcttgataaagttttcattgcagctggctttgaatggagagaagctggctgttctatgtgtctaggtatgaacccagatattttggacaagtacgaacgttgtgcttccacttccaacagaaactttgaaggtcgtcaaggtgccttatctcgtacacatttaatgtctccagccatggctgctgctacagctgttgcaggtcactttgtagacatcagagaatttaaatataataacgctgacgatgctaaagttactatatcttctgatgaagacgaagaacttgaagaagctgcgtatgagcacactgaaccacaacagcccggtgatgccccaactgatgttgagaatgatcagttgaaggacatcccagtcgaatccgaaacaaaaagattaaagacggacgatactaagccagttgctggtggtatggacccatttgtcgttttgaatggtttggctgctccacttgaaaaggctaacgttgatactgatgctattattccaaaacaattcttgaaaacaattaagagaaccggtttgagatcaggtctattttacgaatggagatttgtcaaggatgacagtggaaaagataaagaaacagattttgtgttgaatgtcaacccatggaggaaagctgaggtcctcgttgttactggtgacaactttggttgtggttcctctagagaacacgccccatgggctttgaaagattttggtatcaagtcaattattgctccatctttcggtgatattttctacaataacagtttcaagaatggtttgttaccaattagaattgatcaagataccatcgtaaacaagctagttcctgttgcaaaggctggtaagaatctcgttattaacttaccagatcaaaccatctctgattcggatggcaatgttttggttgaacattttgaagttgaagcattcagaaagcattgtctagtaaatggtctagatgacattggcatcacattgcagaaagaacaatacatcgaccaatacgaaaagattagaagagaaaagtactcattttatgaaggtggttctaagttgctacacttcccagccaagcagttcccaaaaaagagaactccattaacgacttatgacactgttcatcaagattggtaa

SEQ ID NO: 6 - protein, 784 aa, Candida galbrata
MVTTETKGPRTLYDKVFDAHVVHKDENGSYLLYIDRHLVHEVTSPQAFEGLTNANRPVRRVDCTLATVDHNIPTESRKSFKNLDSFITQTDSRLQVKTLEQNVKQFGVPYFGLTEKRQGIVHTIGPEQGFTLPGTTVVCGDSHTSTHGAFGALAFGIGTSEVEHVLATQTIIQSKSKNMRIRVDGKLSPGITSKDLILHIIGVIGTAGGTGSVIEFAGEAIENLSMEARMSMCNMSIEAGARAGMIKPDNVTFEYFKGRPLAPTGAEWDKAVAYWKTLHSDEGAKFDHEIVIKGSEIIPTITWGTSPQDALPISASVPDPANVDDPIKKSGMERALEYMGLKPNTPLKSIYVDKVFIGSCTNGRIEDLRNAAKVLNGHKIAPNIKRAMVVPGSGLVKVQAEEEGLDKVFIAAGFEWREAGCSMCLGMNPDILDKYERCASTSNRNFEGRQGALSRTHLMSPAMAAATAVAGHFVDIREFKYNNADDAKVTISSDEDEELEEAAYEHTEPQQPGDAPTDVENDQLKDIPVESETKRLKTDDTKPVAGGMDPFVVLNGLAAPLEKANVDTDAIIPKQFLKTIKRTGLRSGLFYEWRFVKDDSGKDKETDFVLNVNPWRKAEVLVVTGDNFGCGSSREHAPWALKDFGIKSIIAPSFGDIFYNNSFKNGLLPIRIDQDTIVNKLVPVAKAGKNLVINLPDQTISDSDGNVLVEHFEVEAFRKHCLVNGLDDIGITLQKEQYIDQYEKIRREKYSFYEGGSKLLHFPAKQFPKKRTPLTTYDTVHQDW

SEQ ID NO: 7 - DNA, 2331 bp, Candida albicans
atggctcctaaaacattatacgacaaggtctttgaagaccatatagttcataaagacgattctggttcatatttattatacattgatagacatttagtccatgaggttacttccccacaagcatttgaagggttaaagaatgctggtcgttcagtcagaagaaccgattgtacattagccacagttgatcataatatcccaactatttcaagagcaaatttcaagaatgtcgattcattcatagagcaagatgattctagattgcaagttaagactttagaacaaaacgtcaaggattttgatgttacttattttggtatgacagacgacagacaaggtattgtccatgttgttggtccagaacaaggtttcactttaccaggtaccactgttgtttgtggtgactcccatacttctactcatggtgcctttggttcattggcttttggtattggtacttctgaagtggaacatgttttagctacgcaaactattattcaagccaaatcgaaaaacatgagaattactattgatggtgatttgtctgaaggtatcacttcgaaagatttggttttgcatgtcattggtgttattggtactgctggtggtactggttgtgttattgaatttgctggtaaagccattgagaatttgtcaatggaagcaagaatgtcgatatgtaatatggccattgaagccggtgccagagctggtatgatcaaaccagatgatactacattcaattacatcaaaggtagaccattggctccaaagggacaagaatgggaaaaggccatgaaatattggaaaactttacatactgatgaaggagctaagtttgattacgatattaaaattgctgcttccgatattgttccaactatcacttggggtaactcaccacaagatgcgttaccaataactgctagtgtcccagacccagcaactgtgaccgatccaattaagaaatcgggtatggaaagagcattgaaatatcaaggtttaactccaaacacacctttcaaagaaatcaaaattgataaagcattcattggttcatgtaccaactctcgtattgaagatttaagagcagctgctaaagttgccaaaggtcacaaaaaagccgacaatgtgaaattggtcttggtggtgccgggttctggtttaattaaaaagcaagctgaaaaagaaggtttggataagatttttgaagccgctggattttcatggagagaagccggatgttcaatgtgtcttggtatgaacccagatattttggatcctgaagaaagatgtgcttctacttccaacagaaatttcgaaggtcgtcaaggtgctctttcaagaacccatttgatgtcaccagccatggctgctgctgctgctattaaaggtcatttcactgatattagagaatttgactatgccacacaagatgaacctcaaatacaaattgctcatgaaattgaagacaaagaattacaagaagctgtttatgagcacgaaaaggaatacattgaagataccccagaaactcaagcagaaagacttgaagacattccaaaagatgaaccagaatttaaaagggccagaaccgagatcgacaactctgctgctggtactcctagtattgataacagtttcaaagttttaactggtattactgctccattatacaaagccaatgttgatactgatgccattattccaaaacaatttttgaaaacaatcaagagaaccggattaaaagatggtttgttttatgaattgagatttgttaaaggtgaaaatggtaaagatgtggaaactgattttgtattgaatactgaaccatatagaaaggcagaaattttattggtgacaggagacaattttggttgtggatcaagtcgtgagcatgctccttgggctttgaaagattttggtatcaaaagtataattgccccatcatttggtgatatcttttataataattcttttaaaaatttccttttgccaatcagaataccgcaagaaatcattgaatctaaattggttcccgttgttacatcaggtcatagattgacgatagatttgccaaaccagcaaatcagagacggtgaaaccgacgaagtcttgattgaacatttcgatgtggaagagtttagaaaacattgtttggtcaatggattagatgatattggtttgactttacaaaaagaagaatatattaaagaatatgaagctaaaagaagaatcaagttttctttcttggaaggaggttctaaattaatcaaacctataaaaggtactaaaaagagtatttacggtaacagagcacaagaatggtaa

SEQ ID NO: 8 - protein, 776 aa, candida albicans
MAPKTLYDKVFEDHIVHKDDSGSYLLYIDRHLVHEVTSPQAFEGLKNAGRSVRRTDCTLATVDHNIPTISRANFKNVDSFIEQDDSRLQVKTLEQNVKDFDVTYFGMTDDRQGIVHVVGPEQGFTLPGTTVVCGDSHTSTHGAFGSLAFGIGTSEVEHVLATQTIIQAKSKNMRITIDGDLSEGITSKDLVLHVIGVIGTAGGTGCVIEFAGKAIENLSMEARMSICNMAIEAGARAGMIKPDDTTFNYIKGRPLAPKGQEWEKAMKYWKTLHTDEGAKFDYDIKIAASDIVPTITWGNSPQDALPITASVPDPATVTDPIKKSGMERALKYQGLTPNTPFKEIKIDKAFIGSCTNSRIEDLRAAAKVAKGHKKADNVKLVLVVPGSGLIKKQAEKEGLDKIFEAAGFSWREAGCSMCLGMNPDILDPEERCASTSNRNFEGRQGALSRTHLMSPAMAAAAAIKGHFTDIREFDYATQDEPQIQIAHEIEDKELQEAVYEHEKEYIEDTPETQAERLEDIPKDEPEFKRARTEIDNSAAGTPSIDNSFKVLTGITAPLYKANVDTDAIIPKQFLKTIKRTGLKDGLFYELRFVKGENGKDVETDFVLNTEPYRKAEILLVTGDNFGCGSSREHAPWALKDFGIKSIIAPSFGDIFYNNSFKNFLLPIRIPQEIIESKLVPVVTSGHRLTIDLPNQQIRDGETDEVLIEHFDVEEFRKHCLVNGLDDIGLTLQKEEYIKEYEAKRRIKFSFLEGGSKLIKPIKGTKKSIYGNRAQEW

SEQ ID NO: 9 - DNA, 2358 bp, Kluyveromyces lactis
atgactgctcctgctgctaccgaatcaaacggtccacaaaccttgtatgacaaggttttccaggaccatattgtccataaggatgaatctggatcatatttgttgtatattgatagacatttggttcatgaagttacttctccacaagcttttgaaggtttaaagaatgctggtagaaaagttagaagagttgattgtaccttggctacagtggatcacaacatccctactgaatccagaaagaattttgtcgatactgcatctttcattaagcaagccgattcccgtttgcaagttcaaactttggaacaaaacgttaaggattttggagtcacattttttggtatgactgatgctagacaaggtatcgtgcatattattggtccagaacaaggtttcacattgccaggcaccactgtggtgtgtggtgattcccatacttctactcacggtgcgtttggtgcacttgcatttggtattggtacctctgaagttgagcacgtcttggctacccaaaccattattcaggccaagtcgaagaacatgagaatttacgttgatggtccattgtccccatcagtgacttctaaggatttgatcttacacatcatcggtgtcattggtactgcgggtggtactggttgtgttatcgaattcgcaggtcaagcaattgaggaactgtctatggaagcccgtatgtccatgtgtaatatggccatcgaaggtggtgccagagccggtttgattcaaccagatcaaactactttcgattacatcaagggtagacctttggctccaaagggcgctgaatggaacaaggctgtcgcctactggaagactttacacaccgatgaaggtgctcagtttgattacgatatcactattaaatcaactgatgtcatcccaacaatcacttggggtacttctccacaagatgcattgccaatcactgcctctgttccagatccggcaaccatctctgatcctgctgtaaaggctactgtggaaagagctttgaaatacatgggcttgactccaaacgttccattgaaagaactttctatcgataaggtctttatcggttcttgtaccaatgctagaattgaggatttgagagctgctgctgccgtcgttaagggacataagaaagctgataatgttaaattggctatggttgttccaggttctggtttggtgaagaaacaagctgaatctgaaggcttagacaagatttttgaggaagctggtttcgaatggagagaagctggttgttctatgtgtctaggtatgaacccagatattttggaccctgaagaacgttgtgcttctacttccaacagaaactttgaaggccgtcaaggtgctctatctagaactcatttaatgtctccagcaatggctgctgctgctggtattgctggtcatttcgttgacattagagatcatgaatacagaaacagcgatgttccaaaggtttccattgagcaagaagctgaagacaaaatcttgcaaaatgctgtctatgaacacgaaaaagaaccaatcgaagagggcgagtcagtggatgaacaagtcgatgatcaacaattggatatcccaccttctgatcatgtaacaaaggaaacccctctcaaagatgctccaacatctgctccaaaaggtatggatcctttcctaaaattggacggtattgctgctccagttgacaaggcgaacgttgacactgatgccatcattccaaaacaatttttgaagactattaagagaacaggtttgaagagtggtttgttctatgaatggaggttcaccaaaggtcctgacggtaaggatgtagaaactgattgggtcttgaacgttgaaccttggagaaatgctgaaatcttggtcattactggtgataactttggttgtggttcttccagagaacacgcaccatgggccttgaaggatttcggtatcaagtgtatgattgccccatctttcggtgacattttctacaacaattccttcaaaaacggtttgcttccaatcagacttcctgaagatttaatcgtagaaaagctttcgccattggcagaagctggtgctaaattgatagtcgatttaccatcgcagaagatcatggatgctgaaggtaatgttcttgtggatcatttcgatgttgagcctttcagaaaacactgtttggttaacggtcttgatgatattggtatcacaatgcagaaagaagagtacattgctaagtatgaagccatgagaagagacaggttctctttcttagaaggtggttccaaactaataaaacctatcaagggtactaagaagagtccatttggtaacagggctcaagagtggtaa

SEQ ID NO: 10 - protein, 785 aa, Kluyveromyces lactis
MTAPAATESNGPQTLYDKVFQDHIVHKDESGSYLLYIDRHLVHEVTSPQAFEGLKNAGRKVRRVDCTLATVDHNIPTESRKNFVDTASFIKQADSRLQVQTLEQNVKDFGVTFFGMTDARQGIVHIIGPEQGFTLPGTTVVCGDSHTSTHGAFGALAFGIGTSEVEHVLATQTIIQAKSKNMRIYVDGPLSPSVTSKDLILHIIGVIGTAGGTGCVIEFAGQAIEELSMEARMSMCNMAIEGGARAGLIQPDQTTFDYIKGRPLAPKGAEWNKAVAYWKTLHTDEGAQFDYDITIKSTDVIPTITWGTSPQDALPITASVPDPATISDPAVKATVERALKYMGLTPNVPLKELSIDKVFIGSCTNARIEDLRAAAAVVKGHKKADNVKLAMVVPGSGLVKKQAESEGLDKIFEEAGFEWREAGCSMCLGMNPDILDPEERCASTSNRNFEGRQGALSRTHLMSPAMAAAAGIAGHFVDIRDHEYRNSDVPKVSIEQEAEDKILQNAVYEHEKEPIEEGESVDEQVDDQQLDIPPSDHVTKETPLKDAPTSAPKGMDPFLKLDGIAAPVDKANVDTDAIIPKQFLKTIKRTGLKSGLFYEWRFTKGPDGKDVETDWVLNVEPWRNAEILVITGDNFGCGSSREHAPWALKDFGIKCMIAPSFGDIFYNNSFKNGLLPIRLPEDLIVEKLSPLAEAGAKLIVDLPSQKIMDAEGNVLVDHFDVEPFRKHCLVNGLDDIGITMQKEEYIAKYEAMRRDRFSFLEGGSKLIKPIKGTKKSPFGNRAQEW

SEQ ID NO: 11 - DNA, 2292 bp, Yarrowia lipolytica
atgggacaaacactctacgacaaggtctttgcggaccacgttgtccacgaggacaatggcacttaccttctgttcattgaccggcaccttgtgcacgaggtcacatctccgcaggcgtttgagggtctcaagaacgccggacgacaggtgcgacgtaaggactgcactctggccacggtcgaccacaacattcccaccacgacgcgaaaggacttcaagtcgatcggcacatttatcaaggaggaagactcgcggttgcagtgcacgactctggagcagaacgtcaaggactttggcgtgcggtactttggcatggacgacaagcgacagggaattgtgcacgttgtgggtcctgagcaaggcttcactctgcccggaaccaccgtggtttgcggcgactcgcacacctctacccatggtgcgttcggagctctggcgtttggaatcggaacctccgaggtcgagcacgtgctggcgacccagaccatcatccaggccaagtccaagaacatgcggatcaacgtctccggcaaactgcagccgggcatcacctccaaggatctgattctgcacattatcggcgtcattggcactgctggaggaactggaaccgtcatcgagttctgcggcgaggcgatccgagacctctccatggaggctcgaatgtccatgtgcaacatggcgattgagggaggagctcgagccggcatgatcgctcccgacgagaccaccttccggtacatccggggccgacctctggctcccgagggcgccgagtgggagaaggccgtcacctactggaagactctgcattcggactcggacgcggagttcgatattgacgtcaacatcaagggcgaggacattatccccaccgtcacctggggtacctctcctcaggacgctctgcccatcacgggctccgttcccgacccctccaaggagaccgatcccatcaagcgggccggaatcgagcgtgcgctggagtacatgggtctggaggccaacactcccctcaacgagattgctgtggacaaggtcttcattggatcctgtaccaactcgcgaatcgaggatctgcgggccgccgctgccattgttcggggaaaaaagaaggccgactccgtggtgcgagccatggttgtgccgggctccggtctggtcaagcgaaaggccgaagccgagggtctggacaaggtctttgaggctgcgggcttcgaatggcgagaggctggctgttccatgtgtctgggtatgaaccctgacattctcaacccccgcgagcgatgtgcttccacctccaaccgtaactttgagggtcgacagggtgctctttcgcgcacccatctggtttcgcccgccatggcggctctggctggaatcaccggcaagctgactgacgtgcgggactacctgcccaaggacgaggccaagattgtgattggcgaggacgaggagatggctgaggccaagtatgacgaggagaaacagcccgccgtcaagaaaatgaagaccgccaccgtgacccaggcggaccctgtcgatgagcagaccgacgccgtggccgaggaaaacatcacctcgtcagccaccggcatccccaagttcctggaggtatctggaatcgccgcgcctctgcccaaggccaacgtggacaccgacgccatcatccccaagcagttcctcaagaccatcaagcgaactggactgtcctcgggtctctttttcgagtggcgattcaaggaggtggacggcaagcaggagaagaccgactttatgctcaacgtggctccctgggataaggcttcgattctggttgtttccggcgacaactttggctgtggctcttcccgagaacacgctccctgggctctggccgactttggcatccggtgcatcattgctccttcttttggcgacattttctacaacaactcgttcaagaacggcctgctgcccatccgggtcgacgccgacgtcatcaagtccaagctcatgcccgtggccgacaagggcggctctctgaccgtggatctgcccaaccagaaggtgctgcatggcgacgaggtgctggtggaccactttgaggtcgaggacttccgaaagcactgtctggtcaacggtctggacgatatcggactcaccatgcagaaggaggagttcatcaaggcctacgaggccaagcgatctgataagttctccttccttgagtccaacaccgactctctcattgtcaaccccgtcaagggtaccaagaagtctgctcttggagtcactgcccaggagtggtag

SEQ ID NO: 12 - protein, 763 aa, Yarrowia lipolytica
MGQTLYDKVFADHVVHEDNGTYLLFIDRHLVHEVTSPQAFEGLKNAGRQVRRKDCTLATVDHNIPTTTRKDFKSIGTFIKEEDSRLQCTTLEQNVKDFGVRYFGMDDKRQGIVHVVGPEQGFTLPGTTVVCGDSHTSTHGAFGALAFGIGTSEVEHVLATQTIIQAKSKNMRINVSGKLQPGITSKDLILHIIGVIGTAGGTGTVIEFCGEAIRDLSMEARMSMCNMAIEGGARAGMIAPDETTFRYIRGRPLAPEGAEWEKAVTYWKTLHSDSDAEFDIDVNIKGEDIIPTVTWGTSPQDALPITGSVPDPSKETDPIKRAGIERALEYMGLEANTPLNEIAVDKVFIGSCTNSRIEDLRAAAAIVRGKKKADSVVRAMVVPGSGLVKRKAEAEGLDKVFEAAGFEWREAGCSMCLGMNPDILNPRERCASTSNRNFEGRQGALSRTHLVSPAMAALAGITGKLTDVRDYLPKDEAKIVIGEDEEMAEAKYDEEKQPAVKKMKTATVTQADPVDEQTDAVAEENITSSATGIPKFLEVSGIAAPLPKANVDTDAIIPKQFLKTIKRTGLSSGLFFEWRFKEVDGKQEKTDFMLNVAPWDKASILVVSGDNFGCGSSREHAPWALADFGIRCIIAPSFGDIFYNNSFKNGLLPIRVDADVIKSKLMPVADKGGSLTVDLPNQKVLHGDEVLVDHFEVEDFRKHCLVNGLDDIGLTMQKEEFIKAYEAKRSDKFSFLESNTDSLIVNPVKGTKKSALGVTAQEW

SEQ ID NO: 13 - DNA, 2313 bp, Pichia stipitis
atggcacccagaacattatacgacaaggtctttgaagaccatattgtccacaaggacgaatctggatcgtatctcttatacatagacagacatttagttcacgaagtgacatctccacaggcttttgaaggtttgaagaatgctggaagacctgtcagaagaaccgattgtactttagcaactgttgaccacaatatccccactatttctcgtgtcaacttcaagaacgtcagttcgttcatagaccaggacgattcaagattacaagtggaaaccttggaacagaacgtcaaggactttgacgtgacctattttggcatggacgattccagacagggtattgttcacattgtcggcccagaacaagggttcactttgcctggtaccacagttgtttgtggtgactctcacacttctacccatggtgccttcggggctttggctttcggaattggtacctctgaagtcgagcatgtcttggcaacccagacgattatccaggccaagtctaagaacatgagaatctctgtagagggtgatttgtccgaaggaatcacttctaaggacttggtcttgcatgtcattggtgtcattggtactgccggtggtactggttgtgtcatcgagtttgctggtaaggcaattgaaagtttgtcaatggaagccagaatgtccatctgcaacatggctattgaagccggagcacgtgctggtatgatcaagccagatcagactacctttgactacatcagtggtagaccattagctcctaagggagctgaattagagaaagcattggcttactggaaaactttgcattctgatgaaggtgctcattttgattacgacatcaagatcgctgcttcagatatcgtgcctacaatcacatggggtaactcacctcaggatgccctccctatcactgccagtgttccagacccagcacatgtgactgaccctatcaagaaatcaggtatggaaagagccttgaagtaccagggcttaactcctaacacccgtttggtagatatcaagattgacaaggcctttattggttcgtgtactaacgcccgtatcgaggacttgagagctgctgccaaggtcgctaagggccacaagaaggctgacaacgtcaagttggttcttatcgttcctggatctggattgatcaaagcccaggctgagaaggaaggtttggacaagatctttgaagctgctggtttctcgtggagagaagccggttgttcgatgtgtcttggtatgaacccagatattttagatcctgaagagagatgtgcttctacgtctaacagaaacttcgagggtcgtcaaggtgctcgttccagaacacatttgatgtctcctgccatggctgctgctgctgctatcaaaggtcacttcactgatatccgtgaattcgactacgatacatctgatgaacctgctgttcacattgaacacgaagtcgaagacaaacttctccaagatgctgtgtacgaacacgaaaaggaagtcattgaagacactccaggaacagaacaggaaagactttatgacattcctaaggaaccagaatccaagaaggccaagactgctgctccatctggaggaattgacaagtttggtgttctcactggtattactgctcctttggacaaagctaacgtcgacactgatgctatcattcctaagcagttcttgaagaccattaagagaactggtttgaagtcaggtttattctacgaagccagatacgtgaaggaccctgtaactggcaaagacgttgaaacagactttgttttgaacgtagagccataccgtaaggctgagatcttgttagtcactggtgacaactttgggtgtggttcttcgagagaacacgctccatgggctctcaaggactttggtatcaagtgtatgattgccccatcctttggtgatatcttctacaataattcgttcaagaacggtttgttgcccattagaattcctgctgatgtgattcaatccactttatatcctgtcgtcactgctggccacaaattgactatcgacttgcctgcccagcaaattagagatggagaaaccgacgaagtcttggtggaccactttgacgtcgaagaattcagaaagcattgcttagttaatggtttggacgatattggcttgaccttacagaaggaagagttcatcagcaagtacgaagctgtcagaagagagaagttctccttcttagaaggtggctccaagttaatcaagcctatcaaaggtaccaagaagtctatctatggtgtcaaagcacaagaatggtga

SEQ ID NO: 14 - protein, 770 aa, Pichia stipitis
MAPRTLYDKVFEDHIVHKDESGSYLLYIDRHLVHEVTSPQAFEGLKNAGRPVRRTDCTLATVDHNIPTISRVNFKNVSSFIDQDDSRLQVETLEQNVKDFDVTYFGMDDSRQGIVHIVGPEQGFTLPGTTVVCGDSHTSTHGAFGALAFGIGTSEVEHVLATQTIIQAKSKNMRISVEGDLSEGITSKDLVLHVIGVIGTAGGTGCVIEFAGKAIESLSMEARMSICNMAIEAGARAGMIKPDQTTFDYISGRPLAPKGAELEKALAYWKTLHSDEGAHFDYDIKIAASDIVPTITWGNSPQDALPITASVPDPAHVTDPIKKSGMERALKYQGLTPNTRLVDIKIDKAFIGSCTNARIEDLRAAAKVAKGHKKADNVKLVLIVPGSGLIKAQAEKEGLDKIFEAAGFSWREAGCSMCLGMNPDILDPEERCASTSNRNFEGRQGARSRTHLMSPAMAAAAAIKGHFTDIREFDYDTSDEPAVHIEHEVEDKLLQDAVYEHEKEVIEDTPGTEQERLYDIPKEPESKKAKTAAPSGGIDKFGVLTGITAPLDKANVDTDAIIPKQFLKTIKRTGLKSGLFYEARYVKDPVTGKDVETDFVLNVEPYRKAEILLVTGDNFGCGSSREHAPWALKDFGIKCMIAPSFGDIFYNNSFKNGLLPIRIPADVIQSTLYPVVTAGHKLTIDLPAQQIRDGETDEVLVDHFDVEEFRKHCLVNGLDDIGLTLQKEEFISKYEAVRREKFSFLEGGSKLIKPIKGTKKSIYGVKAQEW

SEQ ID NO: 15 - DNA, 2532 bp, Roseburia inulinivorans
atgggcaattacgattcaacaccgatagctaaaagtgataggattaaaagattggttgatcatttgtatgctaaaatgcctgaaattgaggccgctagagcagagctaattactgaatcctttaaggccaccgaaggtcaacctgttgttatgagaaaggctagagcttttgaacatatactaaagaatttgccaattatcataagaccagaagaactgattgttggctcaactacaattgcccctagaggttgccaaacgtatccagaattctcatacgagtggttagaggctgaatttgaaactgtcgaaacgcgttcagctgacccattttatatttcagaagaaacgaagaaacgtttgctggctgccgatgcttattggaaaggtaaaacaacctcagagttggcaacttcatatatggccccagaaactctaagagccatgaagcataacttcttcacccctggaaactacttctacaatggtgtcggtcatgtcacagttcaatatgaaacagtattagcaatcggcttgaatggagtaaaagagaaggttaggaaagagatggagaattgtcattttggtgatgccgattatagtacaaagatgtgtttcttggagagcattttaatatcgtgtgatgccgtaatcacttatgctaatagatatgccaagatggccgaggaaatggctgaaaaagaaacagatgctgcaaggaggcaagaactattaacaatcgccagggtttgcaaaaacgttcctgaattcccagccgaaagcttccaggaggcctgccaatccttttggttcatacaacaagtgcttcaaattgaatccagtggtcattcaatttccccaggtagatttgatcaatatatgtatccttattacgaaaaggatttaaaggaaggtagcttaactagggaatatgctcaggaactgatcgattgtatctgggttaagttaaatgatctgaataagtgcagggatgctgcctctgctgagggctttgcaggatattccttatttcaaaacttaatcgttgggggccaaacggttcaaggaagggacgccaccaatgatttgagttttatgtgtatcacggcatctgaacacgtctttttaccgatgccgtcgttgtctataagagtttggcatggtagttccaaagcactgcttatgagagcagctgaattgactagaaccggtataggcttacctgcttattacaatgatgaagtcatcataccagctttggtgcataggggtgctactatggatgaagcaagaaattacaacataataggatgtgtcgaaccgcaggttcctggtaaaactgatggctggcacgatgcagcattctttaacatgtgcagacctttggaaatggtgtttagtaatggttatgataacggtgaaattgcatctatacaaactggtaacgtagaatcttttcagagttttgatgagtttatggaagcttacagaaaacaaatgctatataacatagaacttatggtaaatgccgacaacgcgatagattatgcccacgcaaagttggccccattgccatttgagtcatgtttggttgatgactgtataaagagaggaatgtccgctcaggaaggcggcgcaatctataatttcactggtccacagggctttggtattgcaaacgttgctgatagcttgtatacgattaagaaattggtgttcgaggagaagagaattacgatgggtgaattaaagaaagcgttggaaatgaattatggtaagggtttggatgccacaaccgctggtgacatcgcaatgcaggtcgcgaagggactaaaagatgccggacaggaagtgggtcccgacgtgatcgctaatacaatccgtcaagttcttgaaatggaattaccagaagatgtaagaaagagatatgaagagatccatgaaatgatacttgagttaccaaagtatggtaatgatatagatgaagttgatgaattagctagagaagcagcttacttttacacaagaccattagaaacttttaagaatccaaggggtggcatgtatcaagccggcctttatcccgtgtccgctaatgtgccactaggcgctcaaacgggggccacacccgatggacgtttggcgcatacacccgtggcggatggcgttggtccgacatcaggcttcgatatatccggaccaacagcttcttgcaattctgtcgccaagttggatcatgctatagcctctaatggtaccttatttaatatgaagatgcacccaaccgcaatggcaggtgaaaagggcttagaatccttcatatcgttgatccgtggttatttcgatcaacaaggtatgcacatgcaatttaacgtagtagacagggctacactgcttgatgcgcaggcccaccctgaaaagtattcaggcttaattgtcagagtggcaggttattctgccctttttaccacattgtccaagtcattacaagatgatataatcaaacgtaccgaacaagcagacaatagatag

SEQ ID NO: 16 - DNA, 794 bp, Roseburia inulinivorans
atgaaagaatatcttaatacttcaggtagaatatttgatatccagaggtattctattcacgatggccctggtgtgcgtacaattgtgtttctaaaaggttgtgcccttagatgcagatggtgctgtaatcctgaaagccaaagcttcgaagttgaaacaatgacgattaatggaaaacctaaagtcatgggtaaagatgttacagtcgccgaggttatgaagacggtagaaagagacatgccttattaccttcaatcaggtggtggtatcaccttatcgggtggcgaatgtactttgcaaccagaattttcccttggcctattgagagctgcaaaggatttgggcatatccacggcaatagagagcatggcgtacgcaaagtacgaagtaatagaaactcttcttccgtatttggatacgtatttaatggacatcaaacatatgaatcctgagaaacataaagaatacactggtcatgataacttgaggatgttagaaaacgccttaagagtcgcgcattctggtcagaccgaactgatcatcagagtacctgtcatcccaggattcaacgcaactgagcaggaactactagatattgcaaaattcgcagatacactgcctggagttagacaaatacacatcttgccatatcataattttggtcagggtaaatacgaaggattgaacagggactatccgatgggggacactgagaaaccctctaatgaacagatgaaagcttttcaagaaatgattcaaaagaacacttccctacattgccaaatcggtggtta

SEQ ID NO: 17 - DNA, 3378 bp, artificial sequence
  synthesized double coding region
ggatccgtttaaacaggagggccaaaatcatgggcaattacgattcaacaccgatagctaaaagtgataggattaaaagattggttgatcatttgtatgctaaaatgcctgaaattgaggccgctagagcagagctaattactgaatcctttaaggccaccgaaggtcaacctgttgttatgagaaaggctagagcttttgaacatatactaaagaatttgccaattatcataagaccagaagaactgattgttggctcaactacaattgcccctagaggttgccaaacgtatccagaattctcatacgagtggttagaggctgaatttgaaactgtcgaaacgcgttcagctgacccattttatatttcagaagaaacgaagaaacgtttgctggctgccgatgcttattggaaaggtaaaacaacctcagagttggcaacttcatatatggccccagaaactctaagagccatgaagcataacttcttcacccctggaaactacttctacaatggtgtcggtcatgtcacagttcaatatgaaacagtattagcaatcggcttgaatggagtaaaagagaaggttaggaaagagatggagaattgtcattttggtgatgccgattatagtacaaagatgtgtttcttggagagcattttaatatcgtgtgatgccgtaatcacttatgctaatagatatgccaagatggccgaggaaatggctgaaaaagaaacagatgctgcaaggaggcaagaactattaacaatcgccagggtttgcaaaaacgttcctgaattcccagccgaaagcttccaggaggcctgccaatccttttggttcatacaacaagtgcttcaaattgaatccagtggtcattcaatttccccaggtagatttgatcaatatatgtatccttattacgaaaaggatttaaaggaaggtagcttaactagggaatatgctcaggaactgatcgattgtatctgggttaagttaaatgatctgaataagtgcagggatgctgcctctgctgagggctttgcaggatattccttatttcaaaacttaatcgttgggggccaaacggttcaaggaagggacgccaccaatgatttgagttttatgtgtatcacggcatctgaacacgtctttttaccgatgccgtcgttgtctataagagtttggcatggtagttccaaagcactgcttatgagagcagctgaattgactagaaccggtataggcttacctgcttattacaatgatgaagtcatcataccagctttggtgcataggggtgctactatggatgaagcaagaaattacaacataataggatgtgtcgaaccgcaggttcctggtaaaactgatggctggcacgatgcagcattctttaacatgtgcagacctttggaaatggtgtttagtaatggttatgataacggtgaaattgcatctatacaaactggtaacgtagaatcttttcagagttttgatgagtttatggaagcttacagaaaacaaatgctatataacatagaacttatggtaaatgccgacaacgcgatagattatgcccacgcaaagttggccccattgccatttgagtcatgtttggttgatgactgtataaagagaggaatgtccgctcaggaaggcggcgcaatctataatttcactggtccacagggctttggtattgcaaacgttgctgatagcttgtatacgattaagaaattggtgttcgaggagaagagaattacgatgggtgaattaaagaaagcgttggaaatgaattatggtaagggtttggatgccacaaccgctggtgacatcgcaatgcaggtcgcgaagggactaaaagatgccggacaggaagtgggtcccgacgtgatcgctaatacaatccgtcaagttcttgaaatggaattaccagaagatgtaagaaagagatatgaagagatccatgaaatgatacttgagttaccaaagtatggtaatgatatagatgaagttgatgaattagctagagaagcagcttacttttacacaagaccattagaaacttttaagaatccaaggggtggcatgtatcaagccggcctttatcccgtgtccgctaatgtgccactaggcgctcaaacgggggccacacccgatggacgtttggcgcatacacccgtggcggatggcgttggtccgacatcaggcttcgatatatccggaccaacagcttcttgcaattctgtcgccaagttggatcatgctatagcctctaatggtaccttatttaatatgaagatgcacccaaccgcaatggcaggtgaaaagggcttagaatccttcatatcgttgatccgtggttatttcgatcaacaaggtatgcacatgcaatttaacgtagtagacagggctacactgcttgatgcgcaggcccaccctgaaaagtattcaggcttaattgtcagagtggcaggttattctgccctttttaccacattgtccaagtcattacaagatgatataatcaaacgtaccgaacaagcagacaatagataggaaggaaaaacgcgttatgaaagaatatcttaatacttcaggtagaatatttgatatccagaggtattctattcacgatggccctggtgtgcgtacaattgtgtttctaaaaggttgtgcccttagatgcagatggtgctgtaatcctgaaagccaaagcttcgaagttgaaacaatgacgattaatggaaaacctaaagtcatgggtaaagatgttacagtcgccgaggttatgaagacggtagaaagagacatgccttattaccttcaatcaggtggtggtatcaccttatcgggtggcgaatgtactttgcaaccagaattttcccttggcctattgagagctgcaaaggatttgggcatatccacggcaatagagagcatggcgtacgcaaagtacgaagtaatagaaactcttcttccgtatttggatacgtatttaatggacatcaaacatatgaatcctgagaaacataaagaatacactggtcatgataacttgaggatgttagaaaacgccttaagagtcgcgcattctggtcagaccgaactgatcatcagagtacctgtcatcccaggattcaacgcaactgagcaggaactactagatattgcaaaattcgcagatacactgcctggagttagacaaatacacatcttgccatatcataattttggtcagggtaaatacgaaggattgaacagggactatccgatgggggacactgagaaaccctctaatgaacagatgaaagcttttcaagaaatgattcaaaagaacacttccctacattgccaaatcggtggttaggtcgac

SEQ ID NO: 18 - DNA, 60 bp, artificial sequence
  primer
aaccaagtaatacatattcaaatctagagctgaggatgggcaattacgattcaacaccga

SEQ ID NO: 19 - DNA, 60 bp, artificial sequence
  primer
gtaagcgtgacataactaattacatgattaattaactatctattgtctgcttgttcggta

SEQ ID NO: 20 - DNA, 60 bp, artificial sequence
  primer
aatccaaacaaacacacatattacaatagctgaggatgaaagaatatcttaatacttcag

SEQ ID NO: 21 - DNA, 60 bp, artificial sequence
  primer
cataaatcataagaaattcgcttactcttaattaataaccaccgatttggcaatgtaggg

SEQ ID NO: 22 - DNA, 594 bp, artificial sequence
  synthetic double terminator fragment
taagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaat

SEQ ID NO: 23 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 24 - DNA, 270 bp, Saccharomyces cerevisiae
gacctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaa

SEQ ID NO: 25 - DNA, 643 bp, Saccharomyces cerevisiae
gaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctaga

SEQ ID NO: 26 - DNA, 753 bp, Saccharomyces cerevisiae
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 27 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 28 - protein, 255 aa, Bacillus subtilis
MKRESNIQVLSRGQKDQPVSQIYQVSTMTSLLDGVYDGDFELSEIPKYGDFGIGTFNKLDGELIGFDGEFYRLRSDGTATPVQNGDRSPFCSFTFFTPDMTHKIDAKMTREDFEKEINSMLPSRNLFYAIRIDGLFKKVQTRTVELQEKPYVPMVEAVKTQPIFNFDNVRGTIVGFLTPAYANGIAVSGYHLHFIDEGRNSGGHVFDYVLEDCTVTISQKMNMNLRLPNTADFFNANLDNPDFAKDIETTEGSPE

SEQ ID NO: 29 - DNA, 8946 bp, artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcagcatgctagtgaaggccaagttcgtcaagggctttattagagatgttcatccgtatgggtgtaggagagaagtgttaaaccagattgactactgcaagaaagcaattggctttaggggccctaaaaaggttcttattgtaggtgcttcttcaggcttcggactagctactagaatatctgttgcattcggagggcctgaagcccatacaatcggtgtttcatacgagactggagctacagacagaaggataggtacggctgggtggtacaataatatcttctttaaagaattcgctaagaagaaaggtttggtggcaaagaatttcatagaagatgcattttcgaatgaaaccaaggataaagtgataaagtatataaaggacgaatttggtaaaattgatttattcgtatattctttagctgctcctagaagaaaggactacaaaaccggtaatgtttatacctcaagaattaaaacaattctaggtgactttgaagggcctactattgacgtagaaagagatgaaataactttaaagaaggtatcttctgctagtatcgaggaaatcgaagaaacacgtaaagtaatgggcggagaagactggcaggagtggtgtgaggagttattatacgaagattgtttttctgataaagctacaaccatcgcttattcctatattggcagtcctagaacttataaaatatatcgtgaaggaaccattgggattgctaagaaggatttagaagacaaagccaagttgatcaacgaaaagcttaatagagtcataggaggtagggcatttgtgtctgttaacaaagctttagtaaccaaggcatctgcttatattccaaccttccctctatacgctgccatattatataaagtaatgaaagaaaagaacattcacgaaaattgtattatgcaaattgagcgtatgttctcagagaaaatatactccaacgaaaagattcagttcgatgataagggccgtcttagaatggacgatttagaactaagaaaggatgttcaggatgaagttgacagaatttggtctaacataacaccagaaaacttcaaggagcttagtgactacaaggggtataagaaagagtttatgaatctaaatggttttgatttagatggagttgattattccaaggatcttgatattgaattacttagaaaactagagccttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 30 - DNA, 76 bp, artificial sequence
  primer
agtcacatagttaaatggcgctgttcttcgctgcgagcggaaccgggcctggggcgcgtcagcgggtgttggcggg

SEQ ID NO: 31 - DNA, 68 bp, artificial sequence
  primer
ctgatcgttgtttttttttaaataaatgtttatccattctccttacgcatctgtgcggtatttcacac

SEQ ID NO: 32 - DNA, 22 bp, artificial sequence
  primer
gttcttattccctcttgtatcc

SEQ ID NO: 33 - DNA, 20 bp, artificial sequence
  primer
cttggcagcaacaggactag

SEQ ID NO: 34 - DNA, 448 bp, Saccharomyces serevisiae
cccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatc

SEQ ID NO: 35 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 36 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 37 - DNA, 1014 bp, Pseudomonas aeruginosa
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 38 - protein, 338 aa, Pseudomonas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 39 - DNA, 1014 bp, Pseudomonas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 40 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 41 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 42 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 43 - protein, 843 aa, Roseburia inulinivorans
MGNYDSTPIAKSDRIKRLVDHLYAKMPEIEAARAELITESFKATEGQPVVMRKARAFEHILKNLPIIIRPEELIVGSTTIAPRGCQTYPEFSYEWLEAEFETVETRSADPFYISEETKKRLLAADAYWKGKTTSELATSYMAPETLRAMKHNFFTPGNYFYNGVGHVTVQYETVLAIGLNGVKEKVRKEMENCHFGDADYSTKMCFLESILISCDAVITYANRYAKMAEEMAEKETDAARRQELLTIARVCKNVPEFPAESFQEACQSFWFIQQVLQIESSGHSISPGRFDQYMYPYYEKDLKEGSLTREYAQELIDCIWVKLNDLNKCRDAASAEGFAGYSLFQNLIVGGQTVQGRDATNDLSFMCITASEHVFLPMPSLSIRVWHGSSKALLMRAAELTRTGIGLPAYYNDEVIIPALVHRGATMDEARNYNIIGCVEPQVPGKTDGWHDAAFFNMCRPLEMVFSNGYDNGEIASIQTGNVESFQSFDEFMEAYRKQMLYNIELMVNADNAIDYAHAKLAPLPFESCLVDDCIKRGMSAQEGGAIYNFTGPQGFGIANVADSLYTIKKLVFEEKRITMGELKKALEMNYGKGLDATTAGDIAMQVAKGLKDAGQEVGPDVIANTIRQVLEMELPEDVRKRYEEIHEMILELPKYGNDIDEVDELAREAAYFYTRPLETFKNPRGGMYQAGLYPVSANVPLGAQTGATPDGRLAHTPVADGVGPTSGFDISGPTASCNSVAKLDHAIASNGTLFNMKMHPTAMAGEKGLESFISLIRGYFDQQGMHMQFNVVDRATLLDAQAHPEKYSGLIVRVAGYSALFTTLSKSLQDDIIKRTEQADNR

SEQ ID NO: 44 - protein, 264 aa, Roseburia inulinivorans
MKEYLNTSGRIFDIQRYSIHDGPGVRTIVFLKGCALRCRWCCNPESQSFEVETMTINGKPKVMGKDVTVAEVMKTVERDMPYYLQSGGGITLSGGECTLQPEFSLGLLRAAKDLGISTAIESMAYAKYEVIETLLPYLDTYLMDIKHMNPEKHKEYTGHDNLRMLENALRVAHSGQTELIIRVPVIPGFNATEQELLDIAKFADTLPGVRQIHILPYHNFGQGKYEGLNRDYPMGDTEKPSNEQMKAFQEMIQKNTSLHCQIGG

SEQ ID NO: 45 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 46 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 47 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 48 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 49 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 50 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 51 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 52 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 53 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 54 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 55 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 56 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 57 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 58 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 59 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 60 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 61 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 62 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 63 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 64 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 65 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 66 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 67 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 68 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 69 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 70 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 71 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 72 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 73 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 74 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 75 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 76 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 77 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 78 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 79 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 80 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 81 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 82 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 83 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 84 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 85 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 86 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 87 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 88 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 89 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 90 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 91 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 92 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 93 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 94 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 95 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 96 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 97 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 98 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 99 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 100 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 101 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 102 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 103 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 104 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 105 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 106 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 107 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 108 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 109 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 110 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 111 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcattccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctctcacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaattgctcaacgtaaacaaagttgggttgcacctccacctcgttacacaagaggtactctatccaagtatgctaagttggtttccaacgcttccaacggttgtgttttagatgcttga

SEQ ID NO: 112 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEIAQRKQSWVAPPPRYTRGTLSKYAKLVSNASNGCVLDA

SEQ ID NO: 113 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 114 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 115 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 116 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 117 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 118 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 119 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 120 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 121 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 122 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 123 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 124 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 125 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 126 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 127 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 128 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 129 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 130 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 131 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 132 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 133 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 134 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 135 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 136 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 137 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 138 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 139 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 140 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 141 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 142 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 143 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 144 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 145 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 146 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 147 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 148 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 149 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 150 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 151 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 152 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 153 - DNA, 2337 bp, Saccharomyces cerevisiae
atgctgtctgcacgttctgccatcaagagacccattgttcgtggtcttgcgacagtctccaacttgactagagattcaaaagtcaaccaaaacttattagaagatcattcttttattaactacaagcagaatgtggaaacgctggatatcgtaagaaaaagattaaacaggccatttacctacgcggaaaagattttgtacggtcacttggatgaccctcatggtcaagatattcagagaggtgtttcatacctaaaattaagaccagatcgtgttgcctgtcaagatgctactgctcaaatggctattttacaatttatgtccgctggtttaccacaggttgctaagccagtcactgtccactgtgaccatttgattcaagcacaagttggtggtgaaaaagatttgaagagagctatagatctaaacaaggaagtttatgatttcttggcctctgccactgcgaaatataacatgggtttctggaagccaggttccggtatcattcaccaaattgttctggaaaactacgctttcccaggtgctttgatcattggtactgactcccatacaccaaatgctggtggtttaggtcaattggctattggtgttggtggtgctgatgccgttgatgttatggcaggtcgtccatgggaattgaaggctccaaagatcttaggtgttaagttgactggtaagatgaacggttggacttctccaaaggatattattttgaaattggctggtatcacaactgtcaaaggtggtactggtaaaattgttgaatatttcggtgatggtgttgacaccttctccgctactggtatgggtaccatttgtaatatgggtgctgaaatcggtgctaccacatctgttttcccattcaacaaatctatgattgaatatttggaagcaactggtcgtggtaagatcgctgactttgctaaattataccacaaggacctattatctgctgataaggatgctgaatacgatgaggtcgtcgaaattgacttgaacactctggaaccatacatcaatgggccatttacccccgatttggctactccagtttctaagatgaaggaagttgctgttgctaataactggccattggatgtcagagtcggtttgatcggttcttgtaccaattcctcttatgaagatatgtctcgttcagcatccattgtcaaggatgctgctgctcatggtttgaaatccaagaccattttcactgttactccaggttctgaacaaatcagagccactattgaacgtgatggccaattagaaaccttcaaagaatttggtggtatcgttttggcaaacgcctgtggcccatgtattggtcaatgggatcgtagagatatcaagaaaggtgacaagaatactatcgtttcctcttacaacagaaatttcacttctagaaatgatggtaacccacaaactcatgcttttgttgcatctccagaattagtaactgcgttcgccattgcgggtgatttgagattcaaccctctaacagacaaattaaaggacaaggatggtaatgagttcatgttgaaaccaccacatggtgatggtttgcctcaaagaggttatgatgctggtgagaacacttaccaagctccacctgcagaccgtagcaccgttgaagttaaagtttctccaacttcagaccgtctacaactgttgaaaccattcaaaccttgggatggtaaggatgctaaagacatgccaatcttgattaaggccgtcggtaagacaactactgatcatatttctatggctggtccatggttgaaatacagaggtcatttagaaaacatttctaataactatatgattggtgctattaatgctgaaaacaagaaggctaactgtgttaaaaatgtatatactggtgaatacaaaggtgttccagacactgctagagattacagagaccaaggtatcaagtgggttgttattggtgatgaaaactttggtgaaggttcctctcgtgaacacgctgctttggaaccaagattcttgggcggtttcgctatcatcacaaagtctttcgctcgtatccatgaaactaacttgaaaaaacaaggtctattgccattgaacttcaagaacccagctgactatgacaagatcaaccctgatgacagaatcgatattctgggtctagctgaattggctccaggtaagcctgtaacaatgagagttcatccaaagaatggtaagccatgggatgctgtgttgacccatactttcaacgatgagcaaattgaatggttcaaatatggttctgccttaaataaaattaaggccgatgagaagaaataa

SEQ ID NO: 154 - protein, 778 aa, Saccharomyces cerevisiae
MLSARSAIKRPIVRGLATVSNLTRDSKVNQNLLEDHSFINYKQNVETLDIVRKRLNRPFTYAEKILYGHLDDPHGQDIQRGVSYLKLRPDRVACQDATAQMAILQFMSAGLPQVAKPVTVHCDHLIQAQVGGEKDLKRAIDLNKEVYDFLASATAKYNMGFWKPGSGIIHQIVLENYAFPGALIIGTDSHTPNAGGLGQLAIGVGGADAVDVMAGRPWELKAPKILGVKLTGKMNGWTSPKDIILKLAGITTVKGGTGKIVEYFGDGVDTFSATGMGTICNMGAEIGATTSVFPFNKSMIEYLEATGRGKIADFAKLYHKDLLSADKDAEYDEVVEIDLNTLEPYINGPFTPDLATPVSKMKEVAVANNWPLDVRVGLIGSCTNSSYEDMSRSASIVKDAAAHGLKSKTIFTVTPGSEQIRATIERDGQLETFKEFGGIVLANACGPCIGQWDRRDIKKGDKNTIVSSYNRNFTSRNDGNPQTHAFVASPELVTAFAIAGDLRFNPLTDKLKDKDGNEFMLKPPHGDGLPQRGYDAGENTYQAPPADRSTVEVKVSPTSDRLQLLKPFKPWDGKDAKDMPILIKAVGKTTTDHISMAGPWLKYRGHLENISNNYMIGAINAENKKANCVKNVYTGEYKGVPDTARDYRDQGIKWVVIGDENFGEGSSREHAALEPRFLGGFAIITKSFARIHETNLKKQGLLPLNFKNPADYDKINPDDRIDILGLAELAPGKPVTMRVHPKNGKPWDAVLTHTFNDEQIEWFKYGSALNKIKADEKK

SEQ ID NO: 155 - DNA, 2718 bp, Schizosaccharomyces pombe
atgaagctttgcctttcgggctcttcgcaggcaattccatccaaaggaattagtttggttgcagctcgattccaaagcactgcttcgagggcttcctatgtgacaccgccatatgagaagttgatggggaaactccaacaagttcgcaagtttcttcctggtcaaaagctcactttggcggaaaaggtcctttattctcatttggttaaccctgaagagagcttcagtggtgtctctccttcagacattcgtggctccttgtacctcaaactgaatcccgatcgtgtagccatgcaggatgcctctgctcaaatggccttgcttcagtttatgacgtgtggtcttgaaaaaactatgattcccgctagcattcattgtgaccacttgattgttggtcatcgtggtgccaacagtgatatccccgatagcatcgccaataacaaggagatttttgattttttgcaaagtgccgctaaaaagtacggcatacagttttggggcccaggaagtggcattattcaccaaatcgtgctagaaaactatgccgctcctggtggaatgatgcttggaacagattctcatactcccaacgctggtggtttgggtatgattgccattggcgttggtggtgccgatgccgtcgatgctatgaccaatacaccatgggagttaaaagctcccaaaatcatcggtgtcaaccttacgggcgctatgtctggctggactactccaaaagaccttatacttcatttggctggtaagcttaccgttcgtggtggtaccggtcatattattgaatactttggccctggtgttgcgtccctctcttgcactggtatggctactgtttgtaatatgggcgctgaagtcggtgcaaccacctcaatctttccttataccgattctatgcgtcgctatctaattgccacacaccgtgcagaggtcgccgatgctgcgtcggaggttcatagtgaatacaactaccttgctgctgatactggggctaaatatgatcaaataattgacatcaacctttcggaacttaccccttccctcaatggtcccttcactcctgatttgagcactcctgtttcaaaatttggtgaagccattgagaaaaacaaatggcctaaaaagttgtcggctggccttatcggttcatgtaccaattcttcttaccaagatatgacttgtgttgtcgatgttgttgaacaagctatatctgctggacttaaaccaaaggttccatttttggttacaccgggtagtgagcaaattcgcgcaaccattgaacgtgatggcattactgaacgcttggaagaagctggcgctactgtgctggcaaacgcatgtggtccatgcattggtatgtggaagcgtaccgatgacattgcttcaggcgagccaaatgctattcttacaagtttcaatcgtaatttccgctctcgtaatgacggaaatccatcgactatgaacttcttgaccagtcccgtaattgtggctgccaagattttttcctctgatcttgcatttgatcccacgcatgatacattgcaaacacccgatggtaaagccttcaagtttagaccccctcagggcgtcgagcttccttcggctggattcatcgctggtgactcttcctacattcctgagcctaatcctcagcctgttccggaaaccgaagttacaatcgatcccaaatctgatcgtttggaggcccttgaaccctttgagccttaccaaggaggagaaatggaaaaccttaaggttgcagtgaaggtcaaggggaagtgtactaccgatcatatttctgccgctggtaaatggttaaaatacaaaggccatcttagcaacatttgtaacaacacacttattggtgcaatgaatgctgctactggagaagtcaatcgtgcctatgacaatggcaaaggcatgacaattcctgagctgatgtggaagtggaagaaggatggacaaccttggttggtagtagctgaacataactatggtgagggttctgctcgtgagcatgcagctttgcaaccccgtgccatgaatggtcgtattattttgaccaaatcatttgcccgtattcatgagactaatttgaagaagcaaggcgttttgcctttaaccttcgtcaatgaagccgactatgaaaagatagatgcagaggataaggtttccactcgtggtattgaacaacttttagaaggtgttttggaccagcctattacccttgtcgtcactaagaaagacggttcagttgtagagattccttgcaaacacacaatgagtaaagaccagatagaatttttcaaggccggttcagctcttaatttgattcgcgaaaaggcccattctggcgtggtaaatcaaaaggttatagattcaataaaacaacaacctgaccactatgctgatgcgtatatatttaatcgtcattttgttatagccaaaggagatcaactaggattgccttttcacttgaaaggtgtccaggttggtgatacgatacgacttgataaaatcgcttccttcggctcaagagattttactctctttggtaacccgtatgtagacccttcattgtttacgattgaagcggttgtattatcattccctaaaagcgcattaagtgttcgagtaaaacacaagcgtcgtcatcgtcatgatcgtgtaatgaaacataaacaaacgtatactattttaaggtaa

SEQ ID NO: 156 - protein, 905 aa, Schizosaccharomyces pombe
MKLCLSGSSQAIPSKGISLVAARFQSTASRASYVTPPYEKLMGKLQQVRKFLPGQKLTLAEKVLYSHLVNPEESFSGVSPSDIRGSLYLKLNPDRVAMQDASAQMALLQFMTCGLEKTMIPASIHCDHLIVGHRGANSDIPDSIANNKEIFDFLQSAAKKYGIQFWGPGSGIIHQIVLENYAAPGGMMLGTDSHTPNAGGLGMIAIGVGGADAVDAMTNTPWELKAPKIIGVNLTGAMSGWTTPKDLILHLAGKLTVRGGTGHIIEYFGPGVASLSCTGMATVCNMGAEVGATTSIFPYTDSMRRYLIATHRAEVADAASEVHSEYNYLAADTGAKYDQIIDINLSELTPSLNGPFTPDLSTPVSKFGEAIEKNKWPKKLSAGLIGSCTNSSYQDMTCVVDVVEQAISAGLKPKVPFLVTPGSEQIRATIERDGITERLEEAGATVLANACGPCIGMWKRTDDIASGEPNAILTSFNRNFRSRNDGNPSTMNFLTSPVIVAAKIFSSDLAFDPTHDTLQTPDGKAFKFRPPQGVELPSAGFIAGDSSYIPEPNPQPVPETEVTIDPKSDRLEALEPFEPYQGGEMENLKVAVKVKGKCTTDHISAAGKWLKYKGHLSNICNNTLIGAMNAATGEVNRAYDNGKGMTIPELMWKWKKDGQPWLVVAEHNYGEGSAREHAALQPRAMNGRIILTKSFARIHETNLKKQGVLPLTFVNEADYEKIDAEDKVSTRGIEQLLEGVLDQPITLVVTKKDGSVVEIPCKHTMSKDQIEFFKAGSALNLIREKAHSGVVNQKVIDSIKQQPDHYADAYIFNRHFVIAKGDQLGLPFHLKGVQVGDTIRLDKIASFGSRDFTLFGNPYVDPSLFTIEAVVLSFPKSALSVRVKHKRRHRHDRVMKHKQTYTILR

SEQ ID NO: 157 - DNA, 2337 bp, Schizosaccharomyces pombe
atgggctcgcgtatttttacgcaatccaccctcagaagcttttcatgcgctcctgtcgcagccaacattgacgctaaaaaggttgccatgagcaactttgaaaaaaataaatttattaattatcagcgcatcaaagacaatctcgagattgttaagaagcgcttaaaccgtcctctcacatattcagaaaaaatcctttacggtcacttggacgatcccgtaaatcaggatattgaacgtggtgtctcttacttgaagcttcgtcctgatcgtgttgcttgtcaggatgccactgcacaaatggctatccttcaatttatgtccgcgggtatgccggaggtcgctgtccccgtcactgtccattgtgaccacttgatcgaagcctacgaaggtggtcctatcgatctcgaacgtgccaacgttaccaataaggaggtttacgactttttacaaaccgcttgtgccaaatacaacataggcttttggcgccctggttcgggtatcattcatcaaatcgtccttgaaaactatgccttccccggtggtttgttgattggtactgattctcacactcccaacgccggtggtctcggaatggtcgctataggtgttggtggtgctgacgctgtcgatgttatggccaatttgccttgggagttgaagtgtcctaaagtcatcggtgttaagctcactggtcaattaaagggttggacttctcccaaggacgttatcttaaaggttgctggtattcttaccgtcaaaggtggtaccggtgccattgttgagtactttggtcccggtgttgaatctctttcttgcactggtatgggtacgatctgtaacatgggtgctgaaatcggcgctactacctctatcttcccatttaaccctcgtatgtccgagtaccttcgtgccaccaaccgttccgctattgctgattatgctgaagaattcgcccctatcattgccgctgatgaaaatgctcactatgaccaaattattgaaattgatttgaacacattggaaccccatttgaacggtccctttacccccgatttggctaccccaatttccaagttcaaggaagccgtcaagaagaatgattggcctcaagagctcaaagttggtttgattggatcttgtactaactcctcctatgaggatatgtctcgtgctgcctccatttgccaacaagccatcgacaagggcattaaaaccaaatctttgtttaccatcacacccggttccgaacaagttcgtgctactttgactcgcgatggtcagttggacacaatgagaaaggctggtggtattgttttggctaacgcttgcggtccctgtatcggtcagtggaagcgtaccgatgttaagaagggagagaagaactcaatcgtcacctcttacaaccgtaacttcactggtcgtaacgatgctaaccctgccactcatgcttttgtaacctcccccgatattgttactgccatggttttctctggtgacatgaactttaaccctcttactgatactttgaaagataaggatggaaacgactttaagtttgaacctcctaccggtgctggtcttccttccaagggttacgacccaggaagcaacacttatgttgcacctagctcggtcaatgtcaaggatgtcgccattgatcctcattcgaagcgtttacaacgccttactcccttcaagaaatgggatggaaaggatatgaagggtttgaaaatccttatcaaggctaagggcaagtgtactactgatcatatctctgccgctggtccttggttgaagtaccgtggacatcttcaaaacatttctaataactatatgattggtgctattaatgctgaaaacggtgaagcaaataagttgaaggatcaactcaccggtgaatacaagactgtccccaacgttgctattgattatcgtgatcatggaatccgttgggttaccttgggtgaacaaaattttggtgaaggatcttctcgtgagcatgctgctctcgaacctcgttatttgggaggcgccgctgttatcaccaaatcttttgcccgtatccacgaaaccaatcttaaaaagcaaggtttgttgcctttgacttttgccgatcccgcagcttatgacaagatttctcctttcgacaccgtcgatatcgatggtctcactacctttgctcccggtaagcctttaactttggttgttcaccctgctgatggatctgctgagtggtctaccaaacttaaccatacctttaacaaggatcaaattgaatggttcaaggccggtagtgctttgaatcacatggcaaacatgcacaagcaaaagtaa

SEQ ID NO: 158 - protein, 778 aa, Schizosaccharomyces pombe
MGSRIFTQSTLRSFSCAPVAANIDAKKVAMSNFEKNKFINYQRIKDNLEIVKKRLNRPLTYSEKILYGHLDDPVNQDIERGVSYLKLRPDRVACQDATAQMAILQFMSAGMPEVAVPVTVHCDHLIEAYEGGPIDLERANVTNKEVYDFLQTACAKYNIGFWRPGSGIIHQIVLENYAFPGGLLIGTDSHTPNAGGLGMVAIGVGGADAVDVMANLPWELKCPKVIGVKLTGQLKGWTSPKDVILKVAGILTVKGGTGAIVEYFGPGVESLSCTGMGTICNMGAEIGATTSIFPFNPRMSEYLRATNRSAIADYAEEFAPIIAADENAHYDQIIEIDLNTLEPHLNGPFTPDLATPISKFKEAVKKNDWPQELKVGLIGSCTNSSYEDMSRAASICQQAIDKGIKTKSLFTITPGSEQVRATLTRDGQLDTMRKAGGIVLANACGPCIGQWKRTDVKKGEKNSIVTSYNRNFTGRNDANPATHAFVTSPDIVTAMVFSGDMNFNPLTDTLKDKDGNDFKFEPPTGAGLPSKGYDPGSNTYVAPSSVNVKDVAIDPHSKRLQRLTPFKKWDGKDMKGLKILIKAKGKCTTDHISAAGPWLKYRGHLQNISNNYMIGAINAENGEANKLKDQLTGEYKTVPNVAIDYRDHGIRWVTLGEQNFGEGSSREHAALEPRYLGGAAVITKSFARIHETNLKKQGLLPLTFADPAAYDKISPFDTVDIDGLTTFAPGKPLTLVVHPADGSAEWSTKLNHTFNKDQIEWFKAGSALNHMANMHKQK

SEQ ID NO: 159 - DNA, 2367 bp, Kluyveromyces lactis
atgttgtctgctcgtgttgccttgaagaagcaaggagtcgttagacaaggagtcatcagacacttggctaccggagtctctagtactatgactagagactctaaagttcatcaaaatttgttggaagaccattccttcattaactataaacaaaacattgagtatgtcaatatcgtcagagaaagactaggacgtccattgacatacgcagaaaagattttgtacggtcatttggatgatcctcatggtcaagaaatcgaaagaggtgtttcttatttgaaattgagaccagatcgtgttgcttgtcaagatgctaccgctcaaatggctatcttgcaattcatgtcagcaggtttacctcaagttgctaagccattgactgttcactgtgaccatttgattcaagctcaaattggtggtgaaaaggatttgaagagagccattgatatcaacaaggaagtttacgatttcttggctactgctactgctaaatataatatgggtttctggaagccaggttccggtattatccatcaaatcgttttggaaaactatgctttcccaggtgctttgattattggtaccgattcgcatactccaaatgctggtggtctaggtcaattggctattggtgttggtggtgctgatgctgtcgatgtcatgtccgatttggcatgggaattgaaggctccaaagattatgggtgttaagttgaccggtagaatgaacggttggacttctccaaaggatattattctaaagttggctggtatcactaccgtcaaaggtggtactggtaagattgttgaatatttcggtgacggtgttgacactttcagtgctactggtatgggtaccatctgtaatatgggtgctgaaatcggtgccactacatccgttttcccattcaacaagtctatgattgactatttggatgctactggtagagacaagattgctcaattcgctcaattgtaccacaaggatttgttgtccgctgatgaaggtgctgagtacgatgaaatcatcgaaatcgatttgaacactttggaaccatatgtcaatggtccattcactccagatttggctactccaatctctaagatgaaggatgtcgctgtcaagaacaactggcctctagaagttaaagtcggtcttatcggttcttgtaccaactcttcttacgaagatatgtccagagctgcttccgtcgttaaggatgctgctacccacggtctaaaatctaagtctatcttcactgtgactccaggttctgaacaaatcagagctaccatcgctagagatggtcaattggaaactttcaaagaattcggtggtaccgttttggctaacgcttgtggtccatgtatcggtcaatgggacagacaagatatcaagaagggtgacaagaacaccattgtttcctctttcaacagaaacttcactgctagaaacgatggtaacccagatactcactccttcgttgcctctccagaaatcactaccgctttcgccattgctggtgatttgagatttaaccctctaaccgacactttgaaggacaaggacggtaacgaattcatgttgaaaccaccaactggtgttggtttgccagttaagggttacgacccaggtgaaaacacttaccaagctccaccaaaggaccgttcttccgttactgtccaagtttctccaacgtctgaccgtctacaattgttgaaacctttcaaggcttgggatggtaaggatgctttcgatatgccaatcttgatcaaatctctaggtaagaccaccactgaccatatctctatggctggtccatggttgaagtacagaggtcatttggaaaacatttcaaacaactatatgattggtgctattaacgctgaaaacaagaaggctaactgtgtcaagcaccactacactggtgaatacgccggtgttccagacactgctagagcttacagagatgcaggtatcagatgggttgtcattggtggtgaaaacttcggtgaaggttcttctcgtgaacacgctgccttggaaccaagattcttgggtggtttcgctattattaccaaatccttcgcaagaattcacgaaactaacttgaagaaacaaggtatgttgcctttgaactttgctgaaccagctgcttacgacaagatcaacccagatgacaccatcgacatcttgggtttgactactctagctccaggtaagaacttgatcatgagagttcatccaaaggaaggtgaagcttgggaaaccccattgtctcacactttcaacgctgaacaaatcgaatggttcaaggccggttctgctttgaacagattggctaacgccaagaaggctaagaactga

SEQ ID NO: 160 - protein, 788 aa, Kluyveromyces lactis
MLSARVALKKQGVVRQGVIRHLATGVSSTMTRDSKVHQNLLEDHSFINYKQNIEYVNIVRERLGRPLTYAEKILYGHLDDPHGQEIERGVSYLKLRPDRVACQDATAQMAILQFMSAGLPQVAKPLTVHCDHLIQAQIGGEKDLKRAIDINKEVYDFLATATAKYNMGFWKPGSGIIHQIVLENYAFPGALIIGTDSHTPNAGGLGQLAIGVGGADAVDVMSDLAWELKAPKIMGVKLTGRMNGWTSPKDIILKLAGITTVKGGTGKIVEYFGDGVDTFSATGMGTICNMGAEIGATTSVFPFNKSMIDYLDATGRDKIAQFAQLYHKDLLSADEGAEYDEIIEIDLNTLEPYVNGPFTPDLATPISKMKDVAVKNNWPLEVKVGLIGSCTNSSYEDMSRAASVVKDAATHGLKSKSIFTVTPGSEQIRATIARDGQLETFKEFGGTVLANACGPCIGQWDRQDIKKGDKNTIVSSFNRNFTARNDGNPDTHSFVASPEITTAFAIAGDLRFNPLTDTLKDKDGNEFMLKPPTGVGLPVKGYDPGENTYQAPPKDRSSVTVQVSPTSDRLQLLKPFKAWDGKDAFDMPILIKSLGKTTTDHISMAGPWLKYRGHLENISNNYMIGAINAENKKANCVKHHYTGEYAGVPDTARAYRDAGIRWVVIGGENFGEGSSREHAALEPRFLGGFAIITKSFARIHETNLKKQGMLPLNFAEPAAYDKINPDDTIDILGLTTLAPGKNLIMRVHPKEGEAWETPLSHTFNAEQIEWFKAGSALNRLANAKKAKN

SEQ ID NO: 161 - DNA, 2376 bp, Candida Albicans
atgttaagagctagatcagtattaagtgggagtgtgtcgagacgtgcgttagccactcaagcatttaacttttcagttcctccagaatatcaatcgaggactccaccatattctaaattgatcaacaacttatcgacggttaagaaaatattgaaaaaccaaccattgacattagcagagaagatattgtattcacatttatgcaatccagaagaaagtcttacttcatccaatgtaagtgatataaggggccaacaatatttgaagttgcacccagatagagtggccatgcaagatgcttctgcccagatggcattgttacaatttatgacatgtggtatgagttccacagcagttccagcctcaattcactgtgaccatttgattgttggtaaagatggtgctgaggaagatttagttaaatcaatagcaacaaataaagaggtttttgatttcttgcaaagttgtggtgaaaaatacggtattcaattttggggaccaggatctggtatcattcatcaaattgttttagagaactttgccgcacctggtttaatgatgttaggtaccgattcgcatactcctaatgcagggggtttgggtgcaattgccattggtgttggtggtgcagatgctgttgatgcattgacaggtaccccttgggaattgaaagcaccaaagattttgggtgtgaaattaactggcaaattatctggatggagctcgcctaaagatgtaattactactttagcaggtattttgaccgtcagaggaggtactggttatatcgtggaatactttggtgatggtgttaaaacattatcatgtactggtatggctactatctgtaatatgggtgccgaaattggtgccaccacctcgactttcccataccaagaagcccacaagagatatttgattgacacgcatagagcaccaattgccgaagctgctgattcggtgaattccgaattcaaatttttgcaagctgatgaaggtgccgaatacgacaaagtcattgagataaatctttctgaattagaaccacatgtgaacgggcctttcactccagatttgtctactccaatttccaaatttggtgagaccgcccaaaaggaaggttggcctgaaacagtttccgctgggttgattggttcatgtactaattcttcgtaccaagatatgtcccgtgctgtttctatcattaaacaggctgaagcagttggattaaaaccaaaaattccattctttgttacaccaggatccgaacaaatcagagccacaattgaaagagatggtttgataaacacttttgaaagcaatggggccatagtgttggctaatgcatgtggaccatgtattggtcaatgggacagaactgatgttccaaagacatcaacagacttcaacgccattttcacttcattcaacaggaatttccgtgccagaaacgatggtaacagaaacaccatgaactttttaacctctccagatatggttacggccatgatatattccggagatatgaatttcaacccagtgacagattcaatcgaattaccaaatggtaaagagttcagattccaaccaccccaaggtaaagatttgccacaatctggattcatcccaggtcgttctgagttctaccccgaagcaaacccacaaccaaaaccagaggttgaagtcaatgtgtccccaagttcagacagattacaacttttggaacctttccaaccatggtccggtgaagaattgtcaaccacagtattgttgaaagttgaaggaaaatgtactaccgatcatatttcggcagctggtgtctggttgaaatacaaaggtcatttggaaaacatttcatacaatacattaattggtgcagttaacaaagaaacgggtgaagttaacaaggcttatgatttgaacggtgacgcatacggtattcctgaattgatgattaaatggaaggatgaatctagaccgtgggttgtggtagccgaacataactatggtgaaggttctgctagagaacatgctgccttgtcacctcgtttcttgggaggctcagtgattttggtgaaatcttttgctagaatccacgaaaccaacttgaagaaacaaggaatgttgcctttaacttttgcagatgaagctgattatgacaaaatttcatctggcgatttattgacaactatagatttgaaagatatgattgccaaggacggtaacaacggaggtactttacgtgttaaggttaccaaaagagatggttctgaatttgaaattttagctaaacatacaatgtctaaagaccaagttgagttcttcaaagctggttctgccatcaactacatcggtaacacaaaaaagggattgtaa

SEQ ID NO: 162 - protein, 791 aa, Candida Albicans
MLRARSVLSGSVSRRALATQAFNFSVPPEYQSRTPPYSKLINNLSTVKKILKNQPLTLAEKILYSHLCNPEESLTSSNVSDIRGQQYLKLHPDRVAMQDASAQMALLQFMTCGMSSTAVPASIHCDHLIVGKDGAEEDLVKSIATNKEVFDFLQSCGEKYGIQFWGPGSGIIHQIVLENFAAPGLMMLGTDSHTPNAGGLGAIAIGVGGADAVDALTGTPWELKAPKILGVKLTGKLSGWSSPKDVITTLAGILTVRGGTGYIVEYFGDGVKTLSCTGMATICNMGAEIGATTSTFPYQEAHKRYLIDTHRAPIAEAADSVNSEFKFLQADEGAEYDKVIEINLSELEPHVNGPFTPDLSTPISKFGETAQKEGWPETVSAGLIGSCTNSSYQDMSRAVSIIKQAEAVGLKPKIPFFVTPGSEQIRATIERDGLINTFESNGAIVLANACGPCIGQWDRTDVPKTSTDFNAIFTSFNRNFRARNDGNRNTMNFLTSPDMVTAMIYSGDMNFNPVTDSIELPNGKEFRFQPPQGKDLPQSGFIPGRSEFYPEANPQPKPEVEVNVSPSSDRLQLLEPFQPWSGEELSTTVLLKVEGKCTTDHISAAGVWLKYKGHLENISYNTLIGAVNKETGEVNKAYDLNGDAYGIPELMIKWKDESRPWVVVAEHNYGEGSAREHAALSPRFLGGSVILVKSFARIHETNLKKQGMLPLTFADEADYDKISSGDLLTTIDLKDMIAKDGNNGGTLRVKVTKRDGSEFEILAKHTMSKDQVEFFKAGSAINYIGNTKKGL

SEQ ID NO: 163 - DNA, 2373 bp, Yarrowia lipolytica
atgctgagaagtgctcgattttgccaggcacgattctcggccatcaaggctcgtggtcttgccaccaccgccaacgcctccggcctcagcgtgcccgctgacttcaagacccgaacccctccctacgcggagctcatcaaccgtcttgatcaggtcaagaagattatcaaccgaaatgatttgaccttggctgaaaaaattctgtattcacatcttcacaaccctgaggagactcccagcatcactcgaggtgacacttacctcaagctcaaccccgaccgagtggccatgcaggatgcctctgctcagatggctctgttgcagtttatgacctgtggtcttccttccaccgccgtgcctgcgtccattcactgtgaccatctgattgttggccgagacggtgccgatgatgatctgacccgatctatcgctaccaaccaggaggtgttcgacttcctgcagcaatgtgccgagaagtacggcatccagttctggggccccggatccggtatcatccaccagattgtgctggagaacttctctgttcccggtctcatgatgctcggaaccgactctcacactcccaacgctggtggtctcggtgccattgccatcggtgttggaggagccgacgctgtcgacgctttgaccggaactccctgggaactgaaggcccccaagattctcggagtcaagctgactggaaagctgtccggctgggcttctcccaaggatgttattacccatctggctggcaagctgactgtgcgaggaggaaccggaaacatcatcgagtaccacggcgagggtgttgactccctgtcctgcaccggtatggccacaatttgcaacatgggtgccgaggtcggtgctaccacctctacgttcccctttacggagtccatgcgacgatacttggaggccaccggacgagctcccattgccgcagcagcagctgctgctcgagaccgaggcttcttggctgctgacgagggtgctcagtatgacgaggttgtagaggtcaacctgtccgagctcgagccctgtatcaacggtcccttcactcccgatctggccacccccctctccaagtactccaccaaggtcacctctgagaagtggcccgataccgtgtctgccggtctcattggatcatgcaccaactcctcctacgaggacatgacccgagtcgcctctctggttgagcaggcccgagacaacggtctcgaggccaagattcccttcttcatcacccccggatccgagcagattcgagccaccatcaagaaggacggtctgacagacgtgttcgagtctgctggtgcggtggttctggccaacgcctgtggaccctgtatcggtcagtgggatcgaactgacgagaccaagcccggcgagttcaactccatcttcacctctttcaaccgaaacttccgagcccgaaacgatggtaaccccgaaaccatgaacttcctgacctctcccgagattgtcaccgctatgatctactctggagacgctcacttcaaccccatgaccgactccatcaccaccaaggacggcaaggaattcaagttccagccccctaagggtaccgagctgcccgaggagtttgccaagggccgacccgagttctaccccgaggctgccccccagccccatcccgaggtgaacgtgactgtctcccccgattccgagcgactgcagctccttgagccttttgagccctttaacaaccaggagctcaagctctcggtactcatgaaggttgagggcaagtgcaccaccgaccacatttcggccgctggtgcctggctcaagtacaagggccatcttgagaacatttcctacaacaccctgattggtgctcttaacaaggagacccagaaggtcaaccacactattgatgccgctgacggctccgagcagtctatccccgacctcatgatcaagtggaaggagcagggcaagccctggattgttgttgctgagcacaactacggagagggttccgcccgagagcatgctgctctgtctccccgattcctcggtggacaggccatcctagtcaagtctttcgctcgaattcacgagaccaacctcaagaagcagggtatgcttcctctgacctttgagaacgaggccgactacgacaagatccaggcctgcgacactctggagaccctggacctcctggacatgcttgagaagggtggtgacaacggtggctttgtccagatgcgagctaccaagtctgacggctctacctacgacttccgagcccgacacaccatgtctgccgaccaggttgatttcttcaaggctggttctgccatcaacttcattggagcccagaaggctgccaacaagtaa

SEQ ID NO: 164 - protein, 790 aa, Yarrowia lipolytica
MLRSARFCQARFSAIKARGLATTANASGLSVPADFKTRTPPYAELINRLDQVKKIINRNDLTLAEKILYSHLHNPEETPSITRGDTYLKLNPDRVAMQDASAQMALLQFMTCGLPSTAVPASIHCDHLIVGRDGADDDLTRSIATNQEVFDFLQQCAEKYGIQFWGPGSGIIHQIVLENFSVPGLMMLGTDSHTPNAGGLGAIAIGVGGADAVDALTGTPWELKAPKILGVKLTGKLSGWASPKDVITHLAGKLTVRGGTGNIIEYHGEGVDSLSCTGMATICNMGAEVGATTSTFPFTESMRRYLEATGRAPIAAAAAAARDRGFLAADEGAQYDEVVEVNLSELEPCINGPFTPDLATPLSKYSTKVTSEKWPDTVSAGLIGSCTNSSYEDMTRVASLVEQARDNGLEAKIPFFITPGSEQIRATIKKDGLTDVFESAGAVVLANACGPCIGQWDRTDETKPGEFNSIFTSFNRNFRARNDGNPETMNFLTSPEIVTAMIYSGDAHFNPMTDSITTKDGKEFKFQPPKGTELPEEFAKGRPEFYPEAAPQPHPEVNVTVSPDSERLQLLEPFEPFNNQELKLSVLMKVEGKCTTDHISAAGAWLKYKGHLENISYNTLIGALNKETQKVNHTIDAADGSEQSIPDLMIKWKEQGKPWIVVAEHNYGEGSAREHAALSPRFLGGQAILVKSFARIHETNLKKQGMLPLTFENEADYDKIQACDTLETLDLLDMLEKGGDNGGFVQMRATKSDGSTYDFRARHTMSADQVDFFKAGSAINFIGAQKAANK

SEQ ID NO: 165 - DNA, 2343 bp, Pichia stipitis
atgttatctagaactgctgtcagagccccacgctctatccgtgggttggccactgctggcttgaccagagactcccaagtgaaccagaacttgttggaatctcactctttcatccaatacaagaagcaactcgagaacctcgacatcgtcaaggccagattgaacagacctttgacttatgccgaaaagcttctctacggtcacttggacgaccctcacggacaagacatccagagaggtgtctcctacttgaagttgagaccagatcgtgtcgcttgtcaagatgccaccgctcaaatggccattttgcaattcatgtctgccggtttgcctcaagttgccactccttccactgtccactgtgaccatttgatccaggcccaaattggtggtgctaaggatttggccagagctattgacttgaacaaggaagtgtacgacttcttgtcgactgcctgtgccaaatacaacttgggtttctggaagcccggttccggtatcatccatcagatcgtattggaaaactacgccttcccaggtgctttgttgatcggtaccgattcgcacactcctaatgctggtggtttgggtcaattggctattggtgtaggtggtgctgatgccgtcgacgtcatggccgacttggcctgggaattgaaggctccaaagatcattggtgtcaagttgaccggtagaatgtccggctggacctcgccaaaggatatcatcttgaagttggctggtatcaccactgtcaagggtggtaccggttccattgttgaatacttcggttctggtgttgaaaccttctcctgtaccggtatgggtaccatctgtaacatgggtgccgaaattggtgctaccacctctgtcttcccattcaacaactccatggttgactatttgaatgccactggtagatccaacattgccgagtttgccaacttgtacaagaaggactacttgtctgccgacgaaggctgtgaatacgaccaagtcattgaaatcgacttgaacaccttggaaccacacattaacggtcctttcaccccagatttggctactccagtctccaagatgaaggaaactgccatcaagaacggctggccattggaagtcaaggttggtttgattggttcttgtaccaactcttcttacgaagatatgaccagagctgcttctattattgaagacgctgccacccatggcttgaagtccaaggctatctacactgtttctcctggttctgaacaagtcagagccaccattgccagagacggtcaattgaagaccttcgaagactttggcggtgttgtcatggccaacgcctgtggtccatgtatcggtcaatgggacagacaagacattaagaagggtgacaagaacaccattgtgtcttctttcaacagaaatttcactgctagaaacgacggtaatccagccactcacgctttcgtcgcttctccagaaatgaccactgctttcgccatctccggtgacttgggtttcaacccaattaccgacaccttgaaggacgctaacggaaacgagttcaagttgaaggaaccagttggtgttggtttaccagttaacggctacgaccctggtgaaaacacctaccaagctccacctgaagacagatcaacagtccaagtgcaaattgccccaacctccgacagattacaaaagttgactcctttcaagccatgggacggtaaggatgccgaaagattaccaatcttaatcaaggccgttggtaagaccacaaccgatcatatttctatggccggtccatggttgaagtaccgtggtcacttggaaaacatctccaacaactacatgattggtgctatcaacgctgaaaacggtgaagccaacaacgtcaagaaccactacactggtgtatactctggtgttccagacactggtgctgcttacagagatgctggccacaagtgggttgttattggtgacgaaaacttcggtgaaggttcttccagagaacacgctgccttggaaccaagattcttgggtggtttcgctatcatcaccaagtccttcgctcgtattcacgaaaccaacttgaagaagcaaggtttgttaccattgaacttcactgacgttgctgcctacgacaaaatccaaccagaagacgaagtagacttgctcggtttgactgaattggcccctggcaagaacgttattctcagagtccacccagctgacggttctgccacctgggaaaccgaattgtctcacacttacaacattgaacaaattgaatggttcaagtacggttccgctttgaacaagatggctgccgttgctgctgaaaagaagtaa

SEQ ID NO: 166 - protein, 780 aa, Pichia stipitis
MLSRTAVRAPRSIRGLATAGLTRDSQVNQNLLESHSFIQYKKQLENLDIVKARLNRPLTYAEKLLYGHLDDPHGQDIQRGVSYLKLRPDRVACQDATAQMAILQFMSAGLPQVATPSTVHCDHLIQAQIGGAKDLARAIDLNKEVYDFLSTACAKYNLGFWKPGSGIIHQIVLENYAFPGALLIGTDSHTPNAGGLGQLAIGVGGADAVDVMADLAWELKAPKIIGVKLTGRMSGWTSPKDIILKLAGITTVKGGTGSIVEYFGSGVETFSCTGMGTICNMGAEIGATTSVFPFNNSMVDYLNATGRSNIAEFANLYKKDYLSADEGCEYDQVIEIDLNTLEPHINGPFTPDLATPVSKMKETAIKNGWPLEVKVGLIGSCTNSSYEDMTRAASIIEDAATHGLKSKAIYTVSPGSEQVRATIARDGQLKTFEDFGGVVMANACGPCIGQWDRQDIKKGDKNTIVSSFNRNFTARNDGNPATHAFVASPEMTTAFAISGDLGFNPITDTLKDANGNEFKLKEPVGVGLPVNGYDPGENTYQAPPEDRSTVQVQIAPTSDRLQKLTPFKPWDGKDAERLPILIKAVGKTTTDHISMAGPWLKYRGHLENISNNYMIGAINAENGEANNVKNHYTGVYSGVPDTGAAYRDAGHKWVVIGDENFGEGSSREHAALEPRFLGGFAIITKSFARIHETNLKKQGLLPLNFTDVAAYDKIQPEDEVDLLGLTELAPGKNVILRVHPADGSATWETELSHTYNIEQIEWFKYGSALNKMAAVAAEKK

SEQ ID NO: 167 - DNA, 2358 bp, Candida glabrata
atgtttagagctgtcggtagaagaaacctggctacagttagtcgaaatatcccctctgttccggagaatttgagagcatacactccaccttatgctaaattactaaataacttggacaaagttaagcaaatactgaacaatgaaccattgaccttggctgaaaagattctgtactcacatctgtgtaaccccgaagaatctcttacgtcctctagagtcgcagacatcagaggccagaagtacttgaaattgaatcctgatagagtcgccatgcaagacgcctctgcacaaatggctcttttgcagttcatgaccactggcctatcagaaactgctgttccagcatcgatccactgtgatcatttaattgtcggaaaagatggtgaaaccaaggatttgagaaactccattaagaccaaccaggaagtttttgatttcctggagagctgtgcgaagagatacggcatacagttctggggtcctggttccggtattatccatcaaatcgtgctggagaacttctccgcgcctggtttgatgatgctaggtacagactcacacactccaaacgctggtggtctaggtgccatcgctattggtgttggtggtgctgatgccgtggacgccttaactggaaccccatgggaattaaaggcaccaaaggttctgggtgttaaattgaccggtaaactacacggctggtcggctccaaaggatgtcatcaccatgcttgcaggtaaactaaccgttagaggtggtacaggctacattgtcgaatattttggagaaggtgtagaaactctatcatgtaccggtatggccacaatctgtaatatgggtgctgagatcggtgctaccacatccactttcccataccaagctgcacacaagagatatctggaagccactggtagaggttttgttgctactgcagcagacgccgccttggctaactacaatttcctaagagcggatgaaggtgctcaatatgacgaagtaatagaaattaacctatccgagttagaaccacacgtaaatggccccttcactcccgacttgtcgacaccaattactaaatatgctgaaagaagtctggaagaaaaatggcctcaaaatatctccgctgcattgattggttcatgtaccaattcatcataccaagatatgagtcgtgtgatcgatttagtcaaccaagctgaaaaggctggtttgaagcctcgcattcctttctttgttactccaggatctgaagctatcagagctacattggatagagatggccttattaagaaatttgaagataatggtgccattgtgttagctaacgcatgtggtccttgtattggtcaatgggatagagaagatgttccaaaggaatcaagcgagaccaactcaatttttacctcctttaacagaaacttcagggctagaaatgatggtaacagaaacaccatgaatttcctaacctccccagaaatcgttactgctatgagctattcaggtaatgctcaattcaacccattaactgatgctattccattaccaaatggcggtgaatttagattcaatccacctgtaggtgaagaacttccttccaagggatttgaacacggtagggataaattctatccagcaggaaaattaagtgctgatccaaatgttgaagtcaaagtttctccaacctctgatcgtttacaacttttggaacctttcaaaccttggaacggtaaggaattaaggactaatgtattgatgaaggtagaagggaaatgtacaactgatcatatttcagctgcaggtgtatggttgaagtataaaggtcatctggagaatatttcctacaacactttaattggtgcacaaaacaaggaaactggcgaggtgaataaggcttatgacttagatggtactgcctatgatatccctggattgatgatgaagtggaaagaggatggtagaccatggacagttgttgctgagcacaactatggtgaaggttcagcaagagaacatgctgctttgtctccaagatacttgggtggtcaaatgatacttgtcaaatcttttgccagaatccatgagacaaacttgaagaaacaaggtatgctaccactaacatttgctgatgaggcagactatgacagaatttctggtggtgacactttggagactgtgggcctaatagatttagtagctcaagacggtaataatggcgggttcctagatgtcaaagtaactaaaccaaatggtgaaagcttcataatcaaaaccaaacacactctgtcaaaggatcaaattgacttctttaaggctggatcagctatcaacttcattggtgaacaacgtagaaaccactga

SEQ ID NO: 168 - protein, 785 aa, Candida glabrata
MFRAVGRRNLATVSRNIPSVPENLRAYTPPYAKLLNNLDKVKQILNNEPLTLAEKILYSHLCNPEESLTSSRVADIRGQKYLKLNPDRVAMQDASAQMALLQFMTTGLSETAVPASIHCDHLIVGKDGETKDLRNSIKTNQEVFDFLESCAKRYGIQFWGPGSGIIHQIVLENFSAPGLMMLGTDSHTPNAGGLGAIAIGVGGADAVDALTGTPWELKAPKVLGVKLTGKLHGWSAPKDVITMLAGKLTVRGGTGYIVEYFGEGVETLSCTGMATICNMGAEIGATTSTFPYQAAHKRYLEATGRGFVATAADAALANYNFLRADEGAQYDEVIEINLSELEPHVNGPFTPDLSTPITKYAERSLEEKWPQNISAALIGSCTNSSYQDMSRVIDLVNQAEKAGLKPRIPFFVTPGSEAIRATLDRDGLIKKFEDNGAIVLANACGPCIGQWDREDVPKESSETNSIFTSFNRNFRARNDGNRNTMNFLTSPEIVTAMSYSGNAQFNPLTDAIPLPNGGEFRFNPPVGEELPSKGFEHGRDKFYPAGKLSADPNVEVKVSPTSDRLQLLEPFKPWNGKELRTNVLMKVEGKCTTDHISAAGVWLKYKGHLENISYNTLIGAQNKETGEVNKAYDLDGTAYDIPGLMMKWKEDGRPWTVVAEHNYGEGSAREHAALSPRYLGGQMILVKSFARIHETNLKKQGMLPLTFADEADYDRISGGDTLETVGLIDLVAQDGNNGGFLDVKVTKPNGESFIIKTKHTLSKDQIDFFKAGSAINFIGEQRRNH

SEQ ID NO: 169 - DNA, 2334 bp, Candida glabrata
atgttgtctgctagaacagtggtgagaaacactggtgtcaggagactggctacagtctctaacttgactagagactctaaggtcaaccagaacttgttggaggaccattctttcatcaattacaagcaaaacatcgagtatgtcgacatagtgagaaagaggctaggcagaccattgacctacgctgaaaagatcctgtacggtcacttggacgacccacacggacaacagatcgagagaggtgtttcctatttgaagctaagaccagaccgtgtcgcatgtcaggatgctaccgcccaaatggccatcttgcaattcatgtccgctggcttgccagaagtagctagaccagtcacagtccactgtgaccacttgatccaagcccaaattggtggtgagaaggatttgaagagagccgtcgacctaaataaggaagtctacgacttcttggcttctgcctccgctaagtacaacatcggtttctggaagccaggttctggtattatccaccaaattgttctagaaaactacgctttcccaggtgctttgatcatcggtaccgactcccacactccaaacgctggtggtctaggtcaattggctatcggtgtcggtggtgctgatgccgtcgatgtcatggctggtctaccatgggaactaaaggctccaaagattttgggtgttaagttgaccggtagaatgaacggttggacctctccaaaggatatcatcttgaagttggctggtattacaactgtcaagggtggtactggtaagatcgtcgaatacttcggtgaaggtgttgacactttctccgccactggtatgggtactatctgtaatatgggtgctgaaatcggtgctaccacttccgttttcccattcaacaagtctatgattgactacttgaaggctactcgtcgtgacaagatcgccgaattcgctcaattgtaccacaaggatctattgtccgctgaccaaggtgctgaatacgatgaagtcattgaaattgacttgaacactctagaaccatacgttaacggtccatttaccccagatttggccactccaatctctaagatgaaggaagttgctgtcgaaaacaattggccattggaagtcaaggtcggtttgatcggttcctgtactaactcttcttacgaagatatgtctcgttccgcttctatcatcaaggatgctgcctctcacggtttgaaggctaagtccatcttcacagttaccccaggttctgaacaaattagagccaccattgaacgtgatggtcaattggaaactttcaaggaattcggtggtattgtcttggctaacgcctgtggtccatgtattggtcaatgggaccgtcaagacatcaagaagggtgacaagaacactattgtctcttcttacaacagaaacttcacttccagaaacgatggtaacccacaaacccacgctttcgttgcttctccagaaattgttactgctttcgccattgccggtgacttgagattcaacccattgactgacaagttgaaggacaaggatggtaacgaattcaagttgaaggaaccattcggtaacggtttgccagaacgtggttacgacccaggtgagaacacttaccaagctccaccaaaggaccgtaacgctgttgatgttaaggttgctccaacctccgaccgtctacaagtcctaaagcctttcaagccatgggatggtaaggatgctctaaacatgccaatcttgatcaagtctttgggtaagaccaccactgaccatatctctatggccggtccatggttgaagtacagaggtcacttggaaaacatttctaacaactacatgattggtgctatcaatgctgaaaacaagaaggccaacagtgttagaaacgtctacactggtgaatacaagggtgttccagacactgccagagactacagagacgaaggtattaagtgggttgttattggtgatgagaacttcggtgaaggttcttctcgtgaacacgctgctttggaaccaagattcttgggtggtttcgctatcattactaagtcatttgctcgtatccacgaaactaacttgaagaagcaaggtttgttgccattgaacttcaagaacccagctgactacgacaagattaacccagatgacaagattgatattctaggattgaccgagcttgctccaggtaagaacgtcaccatgagagttcatccaaagaacggtgaagcttgggactgtgagttgactcacactttcaacagcgagcaaatcgaatggttcaagtacggttctgctctaaacaagattaaggctgacaaagcttaa

SEQ ID NO: 170 - protein, 777 aa, Candida glabrata
MLSARTVVRNTGVRRLATVSNLTRDSKVNQNLLEDHSFINYKQNIEYVDIVRKRLGRPLTYAEKILYGHLDDPHGQQIERGVSYLKLRPDRVACQDATAQMAILQFMSAGLPEVARPVTVHCDHLIQAQIGGEKDLKRAVDLNKEVYDFLASASAKYNIGFWKPGSGIIHQIVLENYAFPGALIIGTDSHTPNAGGLGQLAIGVGGADAVDVMAGLPWELKAPKILGVKLTGRMNGWTSPKDIILKLAGITTVKGGTGKIVEYFGEGVDTFSATGMGTICNMGAEIGATTSVFPFNKSMIDYLKATRRDKIAEFAQLYHKDLLSADQGAEYDEVIEIDLNTLEPYVNGPFTPDLATPISKMKEVAVENNWPLEVKVGLIGSCTNSSYEDMSRSASIIKDAASHGLKAKSIFTVTPGSEQIRATIERDGQLETFKEFGGIVLANACGPCIGQWDRQDIKKGDKNTIVSSYNRNFTSRNDGNPQTHAFVASPEIVTAFAIAGDLRFNPLTDKLKDKDGNEFKLKEPFGNGLPERGYDPGENTYQAPPKDRNAVDVKVAPTSDRLQVLKPFKPWDGKDALNMPILIKSLGKTTTDHISMAGPWLKYRGHLENISNNYMIGAINAENKKANSVRNVYTGEYKGVPDTARDYRDEGIKWVVIGDENFGEGSSREHAALEPRFLGGFAIITKSFARIHETNLKKQGLLPLNFKNPADYDKINPDDKIDILGLTELAPGKNVTMRVHPKNGEAWDCELTHTFNSEQIEWFKYGSALNKIKADKA

SEQ ID NO: 171 - DNA, 2070 bp, Candida glabrata
atggtggtactgcgtaggtctttccacgtatatactcgactgcagcgcggtcagaacttgactgagaagattgtgcagcaatacagcgtcggtcttgccccaggtaagcgagtgcactccggtgactatgtctccatcaagccagcacacgtcatgtcccatgacaactcctggccagtggcattgaagttcatgaacctcggtgcccgcacagtgaaggaccccaggcagatagtcaacacgctggaccacgacatccagaacaagtccgacaagaacttgaccaagtacagaaacatcgagagcttcgccaagaagcacggcatcgacttctacccggcaggcagaggtatcggccaccagatcatggtcgaggaaggctacgctttcccattgaacttgaccgtggcctcagactcacactccaacacttacggtggtatgggtgccctgggtaccccagtggtgagaacagacgcggctgccatctgggccacaggccagacctggtggcagatcccaccagtggcccaagttgagttcaagggcaagctacatgaatcagtgtcaggtaaagacatcatcgtcgctctgtgcggtgtcttcaacaaggatcaagtgctgaaccacgccatcgagtttacaggagatgccatcaagcacctgcccgtggatttcagattaacaatagccaacatgacgacagaatggggtgccctttcaggtctattcccagtagatgacaccctgatcaattggtacaagaatcgtctgaacatagtcggtcctaaccacccaaggatcaatgagacaaccatcaagaacttggaagacaaagccaaagtattcaaggctgactccgacgccgtctacgctaaaaagctagtcatcgatctatcgactttgactcactatgtgtcaggtccaaatagcgtcaaagtctctaacactgtccaggatctggctcgcgataacataaagatcaacaaggcttacctggtgtcctgtaccaacgctcgtctctctgatttggaatctgccgctaaagtcgtttgcccaacgggagacctctccaaggtcaacaaagttgctgacggtgttgagttctacttcgctgctgcttcttctgaaattgagaaagaagctgctgagaagggtatatggcaagcactattggccgctggctgtaagcctctgccatctggctgtggtccatgtatcggtctaggtgctgggcttctggagccaggtgaagtcggtatcagtgccactaacagaaacttcaagggtagaatgggttcaaaggatgctttggcctacttggcctccccagccgtggttgccgcatctgctgtcttgggtagaatcggttctccagctgaagtatggggtattgaggacgtcaagtcttctggattacttgccgaggagttagcatgcaacactgaaacctcaaccgccacaccagtttctgaaggttctgctgctaaggttgaaatgttagaaggcttcccagaagagattgtaggtgaattggtgctttgtgacgccgacaacgtaaataccgatggtatttacccaggtaagtatacgtaccaagatgatgtctctcgtgagactatggcacaagtctgtatggaaaactatgacggtgaatttggttccaaggctaacgctggtgatattttggtgagtggatttaactttggtaccggttcctccagagaacaagcagctacttctttacttgcaaagggtattaatctggtggttgcagggtccttcagtaacactttctcgagaaactccatcaataacgcattgcttactctggagattccaaccttagttgaaaagctacgttccaagttcgagaatgcaccaaaggaattgaccagaagaactggatggttcttaaaatgggatgttcctaacgctaaagtttatgttacagaaggtagtccagatggccaagtcctattagaacaaaaggtcggtgaactaggtaagaacttgcaagagattattattaaaggcggtcttgaaggttgggtcaagtctcaattgtga

SEQ ID NO: 172 - protein, 689 aa, Candida glabrata
MVVLRRSFHVYTRLQRGQNLTEKIVQQYSVGLAPGKRVHSGDYVSIKPAHVMSHDNSWPVALKFMNLGARTVKDPRQIVNTLDHDIQNKSDKNLTKYRNIESFAKKHGIDFYPAGRGIGHQIMVEEGYAFPLNLTVASDSHSNTYGGMGALGTPVVRTDAAAIWATGQTWWQIPPVAQVEFKGKLHESVSGKDIIVALCGVFNKDQVLNHAIEFTGDAIKHLPVDFRLTIANMTTEWGALSGLFPVDDTLINWYKNRLNIVGPNHPRINETTIKNLEDKAKVFKADSDAVYAKKLVIDLSTLTHYVSGPNSVKVSNTVQDLARDNIKINKAYLVSCTNARLSDLESAAKVVCPTGDLSKVNKVADGVEFYFAAASSEIEKEAAEKGIWQALLAAGCKPLPSGCGPCIGLGAGLLEPGEVGISATNRNFKGRMGSKDALAYLASPAVVAASAVLGRIGSPAEVWGIEDVKSSGLLAEELACNTETSTATPVSEGSAAKVEMLEGFPEEIVGELVLCDADNVNTDGIYPGKYTYQDDVSRETMAQVCMENYDGEFGSKANAGDILVSGFNFGTGSSREQAATSLLAKGINLVVAGSFSNTFSRNSINNALLTLEIPTLVEKLRSKFENAPKELTRRTGWFLKWDVPNAKVYVTEGSPDGQVLLEQKVGELGKNLQEIIIKGGLEGWVKSQL

SEQ ID NO: 173 - DNA, 1728 bp, artificial sequence
  codon optimized coding region
atgctttctacaactaggaatgttggaaagaagctgaacaaatacagtcatataattaccgaaccaaaggaccagggtgctagtcaagccatgctttatgccactggttttaaggaagacgacttcggtaaagcccaagttggcgtaggttcttgttggtggtctggtaatccgtgtaacatgcatttaatggattttaacaacagaattaccgaaagtgttaacaaagctgggttaaagggaatgcaattcaatactattggtgtctctgatggaatctctatgggaacaaagggaatgagatatagtctacaatcgagggaggttattgcagacagcttcgagacgattatgatggcacagcactatgatgcaaatatcgcgattccttcttgtgataaaaacatgccaggtgtcctaatggctatgggacgtcacaacaggccttcaataatggtttatggaggtactatccttcccggttcccctacatgtggaagtgctaagatccccaaaaagatagatgtcgtcagcgcatttcaatcttacggtcaatatttgtctaaagagtttacggaaactgaaagacaagacgtggtccaacatgcttgtccaggcccaggttcctgcggcggtatgtacactgcaaacacaatggcatccgtcgcagaagtccttggtatgacacttccaaactcgtcctcgttccctgcagtatcgaaagaaaaacttaatgaatgtgacactattggagaagcaataaagaagacaatggagttaggtataacgccacgtgacgttatgaccaaagaagccttcgaaaacgccatgacttatgtaattgctaccggtggaagtactaatgctgttcttcacatggtcgctgttgcgcattccgctggtgtaaagatcaccccagacgactttcagagaatttcggacaaaacgcccttgttgggtgactttaagccttctggcaaatatgttatggccgaccttattactgtcggtggtacacaagcagttattaagtatttatacgaagaaggctttctgcatggcaacacaattactattagcggtgacacactggcggagagagctgccaaagctgtaagtttaaaggatggtcaagacatcattagacctttgaccaatccgatcaaaacttctggacacttgcaaattctgtatggatcactggccccaggtggctcagtaggaaaaataaccggcaaagaagggacttacttcaaaggaaaggcaagggttttcaatgatgaacccggcttcatatccgcattagagaatggtgaaatcaaaaagggtgaaaagaccgtagtcatcattaggtatgagggaccaagaggtggaccaggaatgccagaaatgttgaagccatccagtgccttaatgggttatggtttaggtaaggatgttgctctgttaactgacggtagatttagtggcggttctcacggttttcttattggacatatagtacctgaggcggctgaaggtggtcccatagggttagtgagagacggtgatgagataatcattgatgccgataataacaagatagatttacttgtaccagaagaagaaattgctgagcgtcgtagtacttggactgctccacctccacgttacaccagaggttgtttaagtaaatatgcgaaactggtgagcaatgcctcccacggttgtgtaacggatcttaactaa

SEQ ID NO: 174 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 175 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 176 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 177 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 178 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 179 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 180 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 181 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 182 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 183 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 184 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 185 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 186 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 187 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 188 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 189 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 190 - DNA, 2364 bp, Clostridium butyricum
atgataagtaaaggatttagtacccaaacagaaagaataaatattttaaaggctcaaatattaaatgctaaaccatgtgttgaatcagaaagagcaatattaataacagaatcatttaaacaaacagaaggccagccagcaattttaagaagagcattggcattgaaacacatacttgaaaatatccctataacaattagagatcaagaacttatagtgggaagtttaactaaagaaccaaggtcttcacaagtatttcctgagttttctaataagtggttacaagatgaattggatagattaaataagagaactggagatgcattccaaatttcagaagaaagtaaagaaaaattaaaagatgtctttgagtattggaatggaaagacaacaagtgagttagcaacttcatatatgacagaggaaacaagagaggcagtaaattgtgatgtatttactgtaggaaactactattataatggcgtaggacatgtatctgtagattatggaaaagtattaagggttggatttaatgggattataaatgaggctaaggaacaattagaaaaaaacaggagtatagatcctgattttataaagaaagaaaaattcctaaatagtgttattatctcatgcgaagctgcaataacatatgtaaatagatatgctaaaaaggctaaagagattgcagataatacaagtgatgcaaaaagaaaagctgaattaaatgaaatagcaaaaatttgttcaaaagtttcaggagagggagctaaatctttctatgaagcatgtcaattattttggtttattcatgcaataataaatatagaatctaatggacattctatttctccagctagatttgatcaatacatgtatccatattatgaaaatgataaaaatataacagataagtttgctcaagaattaatagattgtatctggattaaattaaatgatattaataaagtaagagatgagatttcaactaaacattttggtggttacccaatgtatcaaaacttaattgttgggggtcaaaattcagaaggaaaagatgcaactaataaagtatcatatatggcattagaagcagctgtccatgtaaagttgcctcagccatctttgtcagtaagaatatggaataagactccagatgaatttttgcttagagcagcagaattaactagagaagggttaggacttcctgcttattataatgatgaagttattattccagcattagtttctagaggtcttacattagaagatgcaagagactacggaataattggatgtgttgaaccacaaaagccaggaaaaacagaaggatggcatgattcagcattctttaatcttgcaagaatagtagagttaactataaattctggatttgataaaaataaacagattggacctaaaactcaaaattttgaagaaatgaaatcctttgatgaattcatgaaagcttataaagctcaaatggagtattttgtaaaacatatgtgctgtgctgataattgcatagatattgcacatgcagaaagagctccattacctttcttgtcatcaatggttgataattgtatcggaaaaggaaagagccttcaagatggtggtgcagaatataacttcagtggaccacaaggtgttggagtagctaatattggagattcattagttgcagttaaaaaaattgtgtttgatgaaaataagattactccttcagaattaaagaaaacattaaataatgattttaaaaattcagaagaaatacaagccttactaaaaaatgctcctaagtttggaaatgatattgatgaagttgataatttagctagagagggtgcattagtatactgtagagaagttaataaatatacaaatccaaggggaggaaattttcaaccaggattatatccatcttcaattaatgtatattttggaagcttaacaggtgctactccagatggaaggaaatccggacaaccattagctgatggggtttctccatcaagaggctgtgatgtatctggacctactgcagcttgtaactcagttagtaaattagatcattttatagcttcaaatggaactttatttaatcaaaaattccatccgtcagcattaaaaggtgataatggattaatgaatttatcatcattaataagaagttattttgatcaaaagggatttcatgttcaatttaatgtaatagataaaaaaatattacttgcagcacaaaaaaatcctgaaaaatatcaagatttaattgttagagttgcaggatatagtgcacagttcatttctttagataaatctattcaaaatgatattattgcaagaactgaacatgttatgtaa

SEQ ID NO: 191 - protein, 787 aa, Clostridium butyricum
MISKGFSTQTERINILKAQILNAKPCVESERAILITESFKQTEGQPAILRRALALKHILENIPITIRDQELIVGSLTKEPRSSQVFPEFSNKWLQDELDRLNKRTGDAFQISEESKEKLKDVFEYWNGKTTSELATSYMTEETREAVNCDVFTVGNYYYNGVGHVSVDYGKVLRVGFNGIINEAKEQLEKNRSIDPDFIKKEKFLNSVIISCEAAITYVNRYAKKAKEIADNTSDAKRKAELNEIAKICSKVSGEGAKSFYEACQLFWFIHAIINIESNGHSISPARFDQYMYPYYENDKNITDKFAQELIDCIWIKLNDINKVRDEISTKHFGGYPMYQNLIVGGQNSEGKDATNKVSYMALEAAVHVKLPQPSLSVRIWNKTPDEFLLRAAELTREGLGLPAYYNDEVIIPALVSRGLTLEDARDYGIIGCVEPQKPGKTEGWHDSAFFNLARIVELTINSGFDKNKQIGPKTQNFEEMKSFDEFMKAYKAQMEYFVKHMCCADNCIDIAHAERAPLPFLSSMVDNCIGKGKSLQDGGAEYNFSGPQGVGVANIGDSLVAVKKIVFDENKITPSELKKTLNNDFKNSEEIQALLKNAPKFGNDIDEVDNLAREGALVYCREVNKYTNPRGGNFQPGLYPSSINVYFGSLTGATPDGRKSGQPLADGVSPSRGCDVSGPTAACNSVSKLDHFIASNGTLFNQKFHPSALKGDNGLMNLSSLIRSYFDQKGFHVQFNVIDKKILLAAQKNPEKYQDLIVRVAGYSAQFISLDKSIQNDIIARTEHVM

SEQ ID NO: 192 - DNA, 915 bp, Clostridium butyricum
atgagtaaggagataaaaggcgttttatttaacatacaaaaattttcgttacatgatgggcctggaataagaactatagtattttttaagggatgttcaatgtcgtgcttatggtgcagtaatccagaatcccaagatattaaacctcaagtaatgtttaataaaaatttatgtacaaaatgtggaagatgtaaatctcaatgtaaaagtgcagctattgatatgaattcagaatataggatagataaaagcaaatgtacagagtgtacaaaatgtgttgataattgcttaagcggggcacttgttattgaaggaaggaattacagtgttgaagacgttataaaggaattgaaaaaagatagtgttcaatatagaagatcaaacggtggaattacactatctggaggggaagtattacttcaaccagattttgcagtggagcttttaaaagagtgtaaatcatatggctggcacactgccattgaaacagcaatgtatgttaatagtgaatctgtaaaaaaagtaattccatatatagatctggctatgattgatataaaaagtatgaatgatgaaatccataggaaatttacaggagtgagtaacgaaataatattacaaaacattaaattaagtgatgaattagctaaagaaataataatcagaattcctgtaatagaaggatttaatgcagatttacaaagtataggagcaatagctcaattttcaaaatcattaacaaatcttaaaagaatagatcttcttccataccataattatggagaaaataagtatcaagcaattggaagagagtattctttgaaagaactaaaatcacctagtaaagacaaaatggaaagattaaaagctttagttgaaatcatgggaataccgtgcacaattggagctgagtaa

SEQ ID NO: 193 - protein, 304 aa, Clostridium butyricum
MSKEIKGVLFNIQKFSLHDGPGIRTIVFFKGCSMSCLWCSNPESQDIKPQVMFNKNLCTKCGRCKSQCKSAAIDMNSEYRIDKSKCTECTKCVDNCLSGALVIEGRNYSVEDVIKELKKDSVQYRRSNGGITLSGGEVLLQPDFAVELLKECKSYGWHTAIETAMYVNSESVKKVIPYIDLAMIDIKSMNDEIHRKFTGVSNEIILQNIKLSDELAKEIIIRIPVIEGFNADLQSIGAIAQFSKSLTNLKRIDLLPYHNYGENKYQAIGREYSLKELKSPSKDKMERLKALVEIMGIPCTIGAE

What is claimed is:

1. A method of converting 2,3-dihydroxyisovalerate to α-ketoisovalerate, comprising providing a recombinant yeast host cell expressing a heterologous dihydroxy-acid dehydratase (DHAD) protein that comprises
    (i) an amino acid sequence having at least 95% identity to SEQ ID NO: 179 or 187; and
    (ii) three conserved cysteine residues that correspond to positions 56, 129, and 201 of SEQ ID NO:179;
wherein the substrate 2,3-dihydroxyisovalerate is present in the yeast host cell and wherein the expressed heterologous DHAD protein catalyzes the conversion of 2,3-dihydroxyisovalerate to α-ketoisovalerate.

2. The method of claim 1, wherein the amino acid sequence of the heterologous DHAD protein comprises SEQ ID NO: 179.

3. The method of claim 1, wherein the amino acid sequence of the heterologous DHAD protein comprises SEQ ID NO: 187.

4. The method of claim 1, wherein the recombinant yeast host cell comprises a disruption in an ilv3 gene that encodes mitochondrial DHAD, resulting in reduced expression of endogenous mitochondrial DHAD.

5. The method of claim 1, wherein the recombinant yeast host cell comprises an engineered isobutanol biosynthetic pathway.

6. The method of claim 5, wherein the engineered isobutanol biosynthetic pathway comprises the following substrate to product conversions:
    (i) pyruvate to acetolactate (pathway step a);
    (ii) acetolactate of (i) to 2,3-dihydroxyisovalerate (pathway step b);
    (iii) 2,3-dihydroxyisovalerate of (ii) to α-ketoisovalerate (pathway step c);
    (iv) α-ketoisovalerate of (iii) to isobutyraldehyde (pathway step d); and
    (v) isobutyraldehyde of (iv) to isobutanol (pathway step e),
and wherein
    (a) the substrate to product conversion of step (i) is catalyzed by an acetolactate synthase;
    (b) the substrate to product conversion of step (ii) is catalyzed by a ketol-acid reductoisomerase;
    (c) the substrate to product conversion of step (iii) is catalyzed by the heterologous DHAD;
    (d) the substrate to product conversion of step (iv) is catalyzed by an α-keto acid decarboxylase; and
    (e) the substrate to product conversion of step (v) is catalyzed by an alcohol dehydrogenase.

7. The method of claim 6, wherein two or more of the enzymes (a), (b), and (d) are heterologous to the recombinant yeast host cell.

8. The method of claim 7, wherein two or more of the enzymes (a), (b), and (d) are over-expressed in the recombinant yeast host cell.

9. The method of claim 1, wherein the yeast host cell is selected from the group consisting of *Saccharomyces, Schizosaccharomyces, Hansenula, Candida, Kluyveromyces, Yarrowia,* and *Pichia.*

10. The method of claim 9, wherein the yeast host cell is *Saccharomyces cerevisiae.*

11. The method of claim 6, further comprising:
    (a) culturing the recombinant yeast host cell under suitable conditions to produce isobutanol from pyruvate; and
    (b) recovering the isobutanol.

12. The method of claim 11, wherein said recovering is by distillation, liquid-liquid extraction, adsorption, decantation, pervaporation or combinations thereof.

13. The method of claim 11, further comprising (c) removing solids from the fermentation medium.

14. The method of claim 13, wherein said removing is by centrifugation, filtration or decantation.

15. The method of claim 13, wherein said removing step (c) occurs before said recovering step (b).

* * * * *